United States Patent 7,432,049 (COMPOSITIONS AND METHODS RELATING TO OSTEOARTHRITIS) - sequence listing, part 8

SEQ ID NO: 49066 - DNA, 514 bp, Homo sapiens
aatgctttgaatgttccacggaaacactggtggacagattctagtgctggagaagaaacacgtttggttggagagccacggaagggtggttttcaagttagctacggcaatcctgaacttctgaagatgtccttgatgtgcaggtggcattccttcgacttctctccagccgagcttccagacatcacatatcactgcaaaaatagcattgcatacatggatcaggccagtggaaatgtaaagaaggccctgaagctgatggggcaaatgaaggtgaattcaaggctgaaggaaatagcaaattcacctacacagttctggaggatggtttgcacgaaacacactggggaatggagcaaaacaagtctttgaatatcgaacacgcaaggctgtgagactacctattggagatattgcaccctatgacattgggggtcctgacaagaatttgggggggacgttggccctgttgctttttataaaacaaaatctatttgaaatcccaaaaaaaaat

SEQ ID NO: 49067 - DNA, 539 bp, Homo sapiens
cactgcgcagaccagacttcgctcgtacttttgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgctttcccatctgtctatctatctggctgcagggaaggaaagaacttgcatgttggtgaaggaggaagtggggtggaagaagtggggtgggacgacagtgaaatctagagtaaaaccaagctgcccaaggtgtcctgcaggctgtaatgcagtttaatcagaggccatttttttttt

SEQ ID NO: 49068 - DNA, 458 bp, Homo sapiens
gagttaacatgtatgatctttagaatagatttttctgaagagtgaaacagcgctgcatacaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggtaactgctggtgagcacatctcttgaagttttgatatgggttgcacaacatttataggactgatttggagagaccgacaataccgagtgcagtcctcccttggtatctagtccaggacccctgtggataccaaaatccaagcaatgccctgcagatcatgggacctatgcatatgaaaaggccggccttggatttgagggtttgcatccctcaaataccata

SEQ ID NO: 49069 - DNA, 193 bp, Homo sapiens
gaggcttttcagcaacccggtccagtactgggagatacagccatccaccttcagatgtgtctacgtgcgctctgcattcaactcggaaactataagtaattctcaagaaagccctcatttttataacctggtaaaatcttgttaatgtcattgctaaaaaataaataaaagctagatactgggaaaaaaaaaa

SEQ ID NO: 49070 - DNA, 255 bp, Homo sapiens
cttgcgttcagaacataaatgcacaaaatttgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattcaaaaaaaaaaa

SEQ ID NO: 49071 - DNA, 628 bp, Homo sapiens
agcaaccctttccaggactgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcaggtagctcatttgagataaagtcaaatgccaaacactagctctgtattaatccccatcattactgggaaagcctcatttgaatgtggggaatccaatacaggctatggtaaaattttactaatggcattattttggaaaaaataaatttaaaaaatccattcaaaaaaaaaaa

SEQ ID NO: 49072 - DNA, 329 bp, Homo sapiens
tgccacggaaaatctgagcggcttctctaagcatctgctggacaagtcaatgtggcaccatgagcttcatggtggcagaagagacaataggtccttagctctcctcccagtacaccccctacttggccagtctgtaggccaacaagaaggttcctttacccccatgcaagacacttatgagaacacattacaagatggctgaccgtggaggatgagtggatcctgaaaggttgcccaaactgttgatttggaaaagaaataagcacatagataaccttattgtgtgctgcatggaaaggaactgaatacatttgcctttaagcaagaaa

SEQ ID NO: 49073 - DNA, 365 bp, Homo sapiens
cggaaacttttcaatctctctaaagatgatgatgtccggccaggatgtggtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagagtgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 49074 - DNA, 477 bp, Homo sapiens
agagaaaaataaattttaaaaaaagggggttaagttacggcaaacgtgagattacagcatatgaatctttagtatgaagtgagagaaagaagagggaggctggttctgttgctcgtatcaataggttatctgtgtccctcatcttggggttacagtggtatttctgcagtattatgaatatgtggttgacccatcctgcaaatgtaccaacatttttgaaagaattcattcaaatctcttatgccaacagaaaagtccttcttgtttaatatctctttacctcagtcctacattttgattctctggaggagattttagcttgcttaaaaagccaaatttggagtcatcaagcctgctgaacctgatggggcagctttttgaacagctttctggaagtaagaacttcaggtgaaaagccctttgatcgcttcagccggacatgcccttcagatggcttattctccgaaaagctttatg

SEQ ID NO: 49075 - DNA, 192 bp, Homo sapiens
ggcctatcagtctcacagaattacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgggcagttaatact

SEQ ID NO: 49076 - DNA, 359 bp, Homo sapiens
atggggaccaactttgagcagatgtttagggctgtcggggacagtaaattccgggaaattcaacaggagctttccagtggaaggaatgaaggccagctgaatggtgaaacaaatacacccattgaaggaaaccaggcgggtgatgcaagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaaga

SEQ ID NO: 49077 - DNA, 370 bp, Homo sapiens
gcaaacccagactcgttgagcagcaacgcaatcaccaccatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttctacatttcaacacacttcacagtacaggaaataaagtaatatgaaa

SEQ ID NO: 49078 - DNA, 143 bp, Homo sapiens
ttgcctggtagagatattcaatgataaagtgccatgaaaaatatttctaagaaagccttaaattcccagaggagtctttacccttaagttttacagcctacaacaagattttgtgttttgtttttcttctggtcagccttgtt

SEQ ID NO: 49079 - DNA, 656 bp, Homo sapiens
ctgccaaccccaaagctaacagaagaaaatatttaacgaaaattagagctgaactgtatgaaattgagatgcgaaaatccatacaaaagattaactaaaccgaaagttgattcttccaaagaataaacaagattgacagaccactaactaaattgttaaagaaaaaagaagacaaaataagtacaatcagaaatgtcaaaggtgacattatcactgactccacagaaatacacacacacacacacacacacacaaactcagagactattatgaacacctattcacacacaaactaggaaacctagaagaaatggataaattcctggaaatatacaatctcccaagattgagccaggaagaaatggaaatcatgaacagaccaataatgagttctgaaattgagtcagtaataaaaaacttcttcacgacaaaagaaaccgtcagcatagtaaatgaacaacgtacagaatgggacaaaatatttgcaaactgtgcatccaacagaggtctaatatccagaatctgtaaggacttaagcggtcaacaagcaaaggacaaccctatttaaaaaatgggcaaaggacatgaacagacgctttcttaaaaagaagacatacttggcagccaacaaatatatgaaaaaatggtcccacatt

SEQ ID NO: 49080 - DNA, 517 bp, Homo sapiens
agggaatggaaagtgttgccttcttcttaggttagcattttgatacatatacagaaagctacatcagcacagttggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctggagattaaaaagcgaatgggtcccggagcaacagctgggtggtgctgagaagccaatgttaaaa

SEQ ID NO: 49081 - DNA, 548 bp, Homo sapiens
  misc_feature 6, 7, 10, 11, 12, 19, 20, 27, 45, 46, 58, 61, 68: n = A,T,C or G
gcgggnnggnnnggggtgnntttgaancctctggaagaccccggnntcctggggaaanggnccccgtntgcttcgaagtattcaataccgctcagtattttaaattaagtgattctaagatttggtttgggatcaataggaaagcatatgcagccaaccaagatgcaaatgttttgaaatgatatgaccaaaattttaagtaggaaagtcacccaaacacttctgccttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggataattatggggggtgattattttttatactgtatgtgccaaagctttactactgttggaaagacaactgttttaataaaagatttacattccaaaaaaaaaaa

SEQ ID NO: 49082 - DNA, 473 bp, Homo sapiens
tgcagcccgtaccttcttgggaatacaattgtttaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggcgaagacagaggttcaggtcgttccaggggtaagaggagcatgaaggatgaccgtcgggacagatactctgcggcaaaagggggggatttaatacctttagagacagggaaaattatgacagaggttactctagcctgcttaaaagagattt

SEQ ID NO: 49083 - DNA, 179 bp, Homo sapiens
attgtgtatatgacgaggaggttgatctccgagttgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaa

SEQ ID NO: 49084 - DNA, 134 bp, Homo sapiens
ccgcaaagccatcgtggaaagagctgcccaactggccatcagagtcaccaaccccaatgccaggctgcgcagtgaagaaaatgagtaggcagctcatgtgcacgttttctgtttaaataaatgtaaaaaaaaaa

SEQ ID NO: 49085 - DNA, 332 bp, Homo sapiens
aaagaagaaagttgaggcagaggtccaagaaaaccgctagctggttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggcctctgccctggacctgtgacattctggactatttctgtgtttatttgtggcgagtgtaacaaccatataataaatcacctcttccgctgttttagctgaagaatt

SEQ ID NO: 49086 - DNA, 307 bp, Homo sapiens
gccaaaagagttaaaggcacgacttgggattttttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcacaa

SEQ ID NO: 49087 - DNA, 276 bp, Homo sapiens
cgtgcaaataaacgctcactccgaattagcggtttatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccgaaaaa

SEQ ID NO: 49088 - DNA, 337 bp, Homo sapiens
tcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtaggtaccatacagattaatatgtagcaaaaatgtatgcttgatatttctcaactgggtaatttttctgctgattccagctgccaaacaatattaagaatgcatctttataaatggggctaattgataatggaaataattaagtaatggactatacaggaggtaataatgagccatatgtt

SEQ ID NO: 49089 - DNA, 364 bp, Homo sapiens
gattggttctatgcgccctggaatattactgcttgtgcgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaatcagttaaacatcacatagtagacagccattaaattataaaaaaattaatttatgaagaaagaccttttgacagattgaaaaaaaaagattttcatagggatatctatttga

SEQ ID NO: 49090 - DNA, 588 bp, Homo sapiens
gaggaagtactcagccggtaaatgcattttgaaaagaaaaagaaggagaaggatctggcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaagggtgagatcttcgacacagaaaaagagaaatatgagattacggagcagcgcaagattgatcaagaaagctggggactcacaaattttaccaaaaatcaaaagctattcct

SEQ ID NO: 49091 - DNA, 285 bp, Homo sapiens
tggtaggaaccaacaaggaaactttcctttaacttcctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcatcattctgcatttagctgtattcatatattgcatttctgtattttttgtttgtattgtaaaaaattcacataataaacgatgttgtgatgt

SEQ ID NO: 49092 - DNA, 434 bp, Homo sapiens
agcctcaggtaggctggggccctcaattgccactattggtacttgctctaagacatatctttccatgaggacaatctttatattcctatgtagattgtaagcttcgatttgtatcccacacagtgccttgaacatcatgagtactttaagtatcttttggttcataaaatttctctttattttcaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtagggatggaacaggatattgttgaagcctcctggaatgtttgagcaagggaattgctttccagatgctaagaagcagcaggggggcttttgaattt

SEQ ID NO: 49093 - DNA, 496 bp, Homo sapiens
tagctacgggaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggcctgatcaagaatttggtgtggacgttgccctgtttgcttttataaaccaaactctatctgaaatcccacaaaaaaaattaactccatatgtgtcctcttgtctaatcttggcaaccaggcaagtgaccgacaaaatccagttatttatttccaaaa

SEQ ID NO: 49094 - DNA, 416 bp, Homo sapiens
  misc_feature 315, 335: n = A,T,C or G
cctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggnggcctgatcaagaatttggngtggcgttgccctgtttgcttttataaaccaaactctatctgaaatcccaacaaaaaaaattaactccatatgggtcctct

SEQ ID NO: 49095 - DNA, 647 bp, Homo sapiens
tcaggtgacctgggctaagtcatttaaactgggtctttataaaagtaaaaggccaacatttaattattttgcaaagcaactctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgctttgtgtaaatcatttgttttgagttttcaaagaatagcccattgtcattcttgtgctggacaatgaccactgtattggtactttgacttttcagagccacccttcctctgggtttggatattatggagggacaataataatgaggaagcatggatatgtatattgctgggttggaagccttattggaaaaaattaaaaggctaacattaaaaggaccaaaaaaaa

SEQ ID NO: 49096 - DNA, 405 bp, Homo sapiens
gaagaggagacagaagaggagctacaaggtgatgatttagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtata

SEQ ID NO: 49097 - DNA, 321 bp, Homo sapiens
tagagcaggcagaaaaatagaccacactgcatgtttccccttgtcctcaatttgtcacttttcagaagaaacttatcacatacctgctgagaaggcagacaggctttagttaaggagaggtaggtcatacagaagctgttattccaagtaagccggtcatgttggagttctggggtactgctgctaataagagatttctccaagatggacatgttttatatgtggaccattcactgcagtagttactagccatgggtggctattgagcaattaaaatgggggtagtatgactgaggaatttaaattttacttaattttaag

SEQ ID NO: 49098 - DNA, 316 bp, Homo sapiens
gtagggggcctgactggcattgaattagtttactcatcagtagacatcgactacacgacacgtactacgttgtagctcacttcactatgtcctatcaataggagctgaatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatcc

SEQ ID NO: 49099 - DNA, 470 bp, Homo sapiens
gtgcaagaagcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgacaactagttagaagttcaagaataaacatgcatttcataactgtcaaatgtcttttaattctgagtccaaataaattattggg

SEQ ID NO: 49100 - DNA, 267 bp, Homo sapiens
ggggtgagacacacattcagtctatagcaggtgccttttaccattctgtggagaaagaggagtcttttcaacaagtattgttgggacagctggatagacacatgcaaaaaaatgaggttggactctcataccatgctacaaagaaaaattaactcaaaatggatcacagacttaaatgtatcagttaaaaactcttggaaagaaacacaaggttaaggattcttggatatgacaccaaaagcatgaacaacaacaacagttaaaaaa

SEQ ID NO: 49101 - DNA, 139 bp, Homo sapiens
gtggtcttttgatttttgctcttagtatagcattgttaaaaaaatataaaagctaccaatctttgtacaatttgtaaatgttaagaattttttttatatctgttaaataaaaattatttccaacaaccttaaaaaaaaa

SEQ ID NO: 49102 - DNA, 447 bp, Homo sapiens
ctctttttatccttaggaaaagatccaggtacttgtgaaaagaatcatgaatgcaacaagggaggctggtcctgttgctgtcgcgattaagttttaaacttttatttattatttacgtctgccgtattttaaataaacattctcgttccttccagttccagtcatagtgtgtctgtggcattccagtccaaccatgtgacttatttattctaatttgagggctgcactgtacaccatgggtcctgtgacaccgtgttccagacatttatgggaaggaaaacatcccatataaatgaaactgtcatgctgttcctccccggcagcagaagatgttccttccattgagtgagggtaaccttatgtccaccaaggatactttgagaaagcccctaagggaacaagcctcaagtcccacggttcagactatttattctctgacacaagaag

SEQ ID NO: 49103 - DNA, 310 bp, Homo sapiens
aactggcctgtagtcttcaaaagtgtcaagctcttgaaagtcaagcaaacagaagccttgattctgaactggaaccttttgctgtgaaaaggatcatggtggaatgattggtgaacctaggattggatggaagtaatgtatcaatgttaacttcctggttttcataggtgtagggcaatgtcattgtgcataagaaatacacaatttggaggtgatggccattgtgttggcaactaactttcaaatagctaagaaaaaataagttatactattctattcttgcactgtctctaagtttaagattctttca

SEQ ID NO: 49104 - DNA, 366 bp, Homo sapiens
caatgtttacattatttaatcttgcaaaaatggctctgtgcacttggatgtgaaatgctgtccagttttattttttttatgttgttatccttggatgtacaaaaaattcagaaaatgatctctgtagatattctgttttattttggcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaaca

SEQ ID NO: 49105 - DNA, 429 bp, Homo sapiens
aaatatcatataaacatttgatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgtggtccaaatgtgtataattttaaagtaatttctaaagcagttattataatggttgcctgcttaaaaggataattaacttctttctcttctacattgacacacagaaatggggcaatgtaaagccaaaaccatcttctgggttatgggccaatctattctcaaagt

SEQ ID NO: 49106 - DNA, 605 bp, Homo sapiens
aagggaatgactagggaagaaaatttaaattctgagacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgtcgtggtagcaccttcaaagaaatccccgtgactgtctataagccaattattaaaaaatacaccaaaatcattgatgggggcctgtggaaatactgaaaaagagacacgagaggaacgaatcattacaggtcctggaaataaaatacctaggattctactggagggggagaaacagaagaactctgaagaaatggtacaagagacacacccgtgaggaagtgcagcccaacaaaaaaggtcaaggatctagaaacgattaa

SEQ ID NO: 49107 - DNA, 323 bp, Homo sapiens
ttgggatcaataggaaagcttatgcagccaaccaagatgcaaatgttttgaaatgagatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaattgggaataa

SEQ ID NO: 49108 - DNA, 338 bp, Homo sapiens
attttttaaaggactgaacagaaatccttagctaggagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacc

SEQ ID NO: 49109 - DNA, 248 bp, Homo sapiens
tgtgccgggtattctagaagaagccgtagtcgttgtaggagacgacagctatgtgccggatattctagaacaagccgtcgtcgtcgtaggagacgacagctctgtgccggtattccacctgaagaccttgcagtgggacaggatgcggacgtggaagacagcgacactgatggtcctgaccctgtgcgggtttaggctaatgtgtgtttgtgtcttagtttttaaccaaaaagtttaaaaagaaaaaa

SEQ ID NO: 49110 - DNA, 555 bp, Homo sapiens
agactggaacttgaactgattcacatctcatttttccttaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcggctcactgacctgcctgtagccccagtgacagctaggatgtgcattctccagccatcaagagactgagcaaggtggtccttaatcagaacagcagactcaagctctgacatctgatcgaatgacactgtcaggaatcggaatcctgcgataagactggacagcttgtggcaagggaatttgcctgaacaagccagaatttttaaaaattaaat

SEQ ID NO: 49111 - DNA, 236 bp, Homo sapiens
cctattaaatgttccttatacataaaatgatctgagttaaatccaaaattatttcctaacatcttacgtactgggtataaaagaggttcgctcttcagatatacagagcacacacttactgtattgaaaatatgattacattcagcctaggcaaaccatcattttaggcttacatgacataaatgtatttttgttaaatcttaagacatttctgtccacaggcatggttaaaaaaa

SEQ ID NO: 49112 - DNA, 220 bp, Homo sapiens
acagagaacggtaagcccggcatgcttaagaaaactcctggaatcttgtaaagatctttctttacttgatgtgtccttctgttcgcagattgataacagagctgtgctagaactgaatgcaagctttccaaaagtgttcataaaaaaagagctttactcagtgacttaatatatgttctgtattaaaattaatgtgctttgttggggtttaattttggga

SEQ ID NO: 49113 - DNA, 297 bp, Homo sapiens
gtctagaaaagtattcgttacgtcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgtcaaaaataactcagacccagtcttgtggatggaaatgtagtgctcgagcacattctgcttaaagttgtaacaaatacagatgagtt

SEQ ID NO: 49114 - DNA, 449 bp, Homo sapiens
tccggacacgtgagtgcaagaatcaagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgcacggattagttgtacaactagttagaagttcagaataaacatgcatttcataactgtcaaaa

SEQ ID NO: 49115 - DNA, 569 bp, Homo sapiens
gctgtgttagggtggctaatccctttacacaagattgttagccaccaaactgagaccttgatacctttgtttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgacatgaaaagttttaaagatatgtttaagaccaagactattaaaatgatttttaaagttgttggagacgccaatagcaatatctaggaaatttgcattggagaccattgtattttccactagcagtgaaaatgatttttcacaactaacttgtaaatatatttaaatcattacttctttttttctaggccattttaattgggacatcaaccacagacaatttaaatttatagagcactaagaatcactgcgcaggagggtacatagcaaaaatgcaaaggggaccaggaaggaaatttcgggctttccgccgg

SEQ ID NO: 49116 - DNA, 255 bp, Homo sapiens
aaaacttgatttagcattcatattttccttcttattcccaattaaaagtatgcaggaatatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaatgaaaaaaa

SEQ ID NO: 49117 - DNA, 523 bp, Homo sapiens
atgtttttggacagatttacaaggttggtaaccggtagtggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggcctttggggcttggcagggccgtgacacaggttctggccaatgatttgcaagaggaattgatcagtatcactttaagtcctgcatttaattggcagcacaagatcctgcagagcctctttccctctgccacagttatcaagaatgggcaaggagaccggtgcttctgggcataagtcctgcaagggaaagcacatggaaaacaagcccactcacccatgagggatgaaaagcactgtggagaaaggcatgtgttggttaagccattgggaatttaagagctttttgg

SEQ ID NO: 49118 - DNA, 306 bp, Homo sapiens
caggaggataatttcatccaggtgtgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactggaaacgca

SEQ ID NO: 49119 - DNA, 136 bp, Homo sapiens
atgaaaacgtgtttttcaagacctcgggattctttaatgtgggaggtgactttatttcatcatgagtagcaaatttggatgtagactgacagacatagctgaatgtcttaataaatttaaatttgaagatagcaaa

SEQ ID NO: 49120 - DNA, 409 bp, Homo sapiens
gcggctcgaggcagacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgtcaacgattaaagtcctacgtgatctgagttcagaccggagtaatccaggtcggtttctatctacttcaaattcctccctgacgaaaggacaagagaaataaggcctacttcacaaagcgcttcccccgtaaatgatatcatctcaacttagtattatacccacacccacccaagacagggttggta

SEQ ID NO: 49121 - DNA, 228 bp, Homo sapiens
cgccctgttcctcggtgtggctacggagccacgcgctacaattacctaaaacctcgggcagaagaggagaggaggatagcagcagaagagaagaagaagcaggatgaactgaaacggattgccagagaattggcaagaagatgacagcatattaaagtgagtgaccctgcgacccactctttggaccagcagcggatgaataaagcttcctgtgttgtgtgataaaaa

SEQ ID NO: 49122 - DNA, 480 bp, Homo sapiens
gctggggaaaaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttgttttccctaattgcgggcctcaccattgcatgcaatgactattttgtagtacacatgaagcagaagggaaagaagtaggcagaaatgagcagttcgctcctccctgataagagttgcccaaagggtcggcttaaggaatctgccccacagcttcccccatagaaggatttcatgagcagatcaggacacttagcaaatgtaaaaataaaatctaactctcatttgcaagcagaggaaagaaaagttaaataccagataagcttttgatttttggattggttgcatccccttgccctcaataaataaaggtcttttttaggt

SEQ ID NO: 49123 - DNA, 238 bp, Homo sapiens
tagccttaaaagggcaaatctgtaattggccttaattaggaggtagagaaagagatggggtagaaagtttattcaaacggataatagaaaacttcccgaacctatagaaagatatcaatatccaagtacaacaaggttatagaacaccaagtagatttaacccaaagaagactacctcaaggcatttaatagtcaaactcccaaaggtcaaggataaagaaaggatcctaaaagccgc

SEQ ID NO: 49124 - DNA, 487 bp, Homo sapiens
  misc_feature 435: n = A,T,C or G
tttactcagccacccagagtggagcagaggatgctactggattgaccctaaccaaggatgcactatggatgctatcaaagtatactgtgatttccaggggcaagagacacgtctggctagggagaaactatcaatgctggcagccagtttgaatataatgtagaaggagtgacttccaaggaaatggctacccaacttgccttcatgcgcctgctggcaactatgcctctcagaacatcacctaccactgcaagaacagcattgcatacatggatgaggagactggcaacctgaaaaaggctgtcattctgcagggctctaatgatgttgaacttgttgctgagggcaacagcaggttcacttacactgttcttgaagatggctgctctaaaaagacaaatgaatggggaaagacaatcattgaatacaaaacanataagccatcacgcctgcccttccttgatattgcacctttggacatcggggg

SEQ ID NO: 49125 - DNA, 393 bp, Homo sapiens
gccgctcgtgagactccagcagccaagatggtgaagcagatcgagagcaagactgcttttcaggaagccttggacgctgcaggtgataaacttgtagtaagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattaagtctaatcatgttttctgaaaacataaccagccattggttatttaaaacttg

SEQ ID NO: 49126 - DNA, 449 bp, Homo sapiens
cacctacacagatgtggaggatggttgcacgaaacacactggggaatggagcaaaacagtctttgaatatcgaacacgcaaggctgtgagactacctattgtagatattgcaccctatgacattggtggcctgatcaagaatttggtgtggacgttggcctgtttgctttttataaaccaaactctatctgaaatcccaacaaaaaaaatttaactccatatgtgttcctcttgtctaatcttgcaaccaggcaagtgaccgacaaaattccagttatttatttccaaaatgtttggaaacagtataatttgacaaagaaaaatgatacttctctttttttgctggtccaccaaatacaattcaaatgctttttggtttattttttaccaattccaattcaaaaggctcaatggggctataataaataaacttcaacactctttatgat

SEQ ID NO: 49127 - DNA, 300 bp, Homo sapiens
  misc_feature 220, 292: n = A,T,C or G
aagattcaacttcacccgtaacccaccgcatgccgaggaaggcattgctgctggaggtgtaatggacgttaatactgctttacaagaggtctgaagactgccctcatccacgatggcctagcacgtggaattcgcgaagctgcaaagccttagacaagcgccaagcccatctttgtgtgcttgcatccaactgtgatgagcctatgaatgtcaaggtggnggaggccctttgtgctgaacaccaaatcaacctaattaagggtgatgacaacaagaaactaggagaatgggnagcctttg

SEQ ID NO: 49128 - DNA, 300 bp, Homo sapiens
  misc_feature 180, 215, 272, 283: n = A,T,C or G
cgaactgtcaaagaggtgctgcccgctttggagaacaacaaggagcagatcagaagatcattgagacactgacacagcaggcttcagggaaaagggaaaagactaaatgaattccggaaaagcacaacattcgctcatgggagaagatgagaagcagcagcaaggaaaactcagaagggntggggctaaggccagctcagctggagtgttggctnctagggccaaggcctttgatttttttctaccctgctccacttctaattctctttatngtataataatnatttctctgctatggaa

SEQ ID NO: 49129 - DNA, 135 bp, Homo sapiens
  misc_feature 16, 28, 34, 55, 63: n = A,T,C or G
acaagcatgatcttgntactgtgatatnttaaanatccacagtactcactttttncaaatgancctagtaattgcctagaaatatctttctcttacctgttatttatcaattttcccagtatctttatacgagaa

SEQ ID NO: 49130 - DNA, 300 bp, Homo sapiens
  misc_feature 25, 50, 56, 104, 127, 154, 189, 228, 265, 288: n = A,T,C or G
catgaggcaagggctgggacacagngtctttgcctatggaagatccatgngaatgncaggaagccagctcttcagcttggagatgatttctgctacaattctgnagaaagaataaggatggcagagnaaaaggtaccaagaatgccagggatgnttttcttgggccggaggaggccagatactttcctntttgatgaaagagttggaagactggcccatctctctggnttgagaaatctctgccatttaaacatcactgggaaanagcaattattatcatctggattnaggttaacatta

SEQ ID NO: 49131 - DNA, 300 bp, Homo sapiens
  misc_feature 129, 149, 163, 201, 276, 280: n = A,T,C or G
gtaagatattgcaccctatgacattggtggtcctgatcaagaatttggtgtggaccgttggcctgtttgctttttataaaccaaactctatctgaaatcccaacaaaaaaaatttaactccatatgtgntcctcttggtctaatcttgncaaccagtgcaagngaccgacaaaattccaggtatttatttccaaaatggtnggaaacagtataattggacaaagaaaaatgatacttctcttttttgctgtccaccaaatacaattcaaatgcttntggnttaatttttttaccaattcc

SEQ ID NO: 49132 - DNA, 327 bp, Homo sapiens
agactccagcagccaagatggagaagcagatcgagagcaagactgcttttcaggaagccttggacgctgcaggtgataaacttgtagtagttgacttctcagccacgtggtgtgggccttgcaaaatgatcaagcctttctttcattccctctctggaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaat

SEQ ID NO: 49133 - DNA, 367 bp, Homo sapiens
gaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatgggaagggctatgcctgcttccagtgccccaaaatttgcaaaacagctgctgcccttggaatgcaccaaaagaaacacttattcaaaagcccaagtcagcaggagaaaataggtgacgtgtgccacgaaaactcaaatcccttggagaatcaacatttcattggt

SEQ ID NO: 49134 - DNA, 300 bp, Homo sapiens
  misc_feature 222, 274, 285: n = A,T,C or G
aacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgnaaaaaaagcaaaaatgacaacagaaaaacaatcttattccgagcattccagnaacttttttgngtatgtacttagctg

SEQ ID NO: 49135 - DNA, 324 bp, Homo sapiens
tgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagactgaaactagccctgtagatttgtctggtgcatgtgatgaaacctgcagctttatcggagtgatggcaatgctctgctggtttattttcaagtggctgcgtttttttagtt

SEQ ID NO: 49136 - DNA, 300 bp, Homo sapiens
  misc_feature 31, 51: n = A,T,C or G
aataatggaactattttttttaagtggaggnagtttgttctccaagggggnaaaatagaccatgaactatacacaaaagtgaatccagagattaaaaacagaaatatggaaaagctatgtactaaaatgcatatgaccttgggaatagggaaacattccttggaacaatttgagaaatacttagcggtctacttatgagtatgaatgctcaggaaatacgcactaggatatttactgtggcttgatttgtagtagccaaaaattagaaacaactgagaaagcccatcacgacaatatggg

SEQ ID NO: 49137 - DNA, 384 bp, Homo sapiens
ggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctg

SEQ ID NO: 49138 - DNA, 177 bp, Homo sapiens
  misc_feature 85, 103: n = A,T,C or G
cagagtgctgggattacaattgtgagccaccacgtccagctggaagggcaacatcttttacattctgcaagcacatctgcatttncaccccacccttcccctncttctccctttttatatcccatttttatatcgatctcttattttacaataaaactttgctgccacttgaaaaaa

SEQ ID NO: 49139 - DNA, 365 bp, Homo sapiens
tgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcaagtggtggaagaacggtctcagaactgtttgtttcaattggccatttaagtttagtagtaaaagactggttaatgataacaatgcatcgtaaaaccttcagaaggaaaggagaatgttttgggaccact

SEQ ID NO: 49140 - DNA, 172 bp, Homo sapiens
  misc_feature 41, 52: n = A,T,C or G
attgatttactggttgatgatagattttataacctaacggntctcatgcggngcgtaattgtagatgcatgtacttgtgtgttttgtgtaattattgaagtgcaatgatgtataaaaaggtggattcacctgtttttaaaaataaaacattgataaaagttaaaaaaaaaaa

SEQ ID NO: 49141 - DNA, 369 bp, Homo sapiens
aacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaata

SEQ ID NO: 49142 - DNA, 300 bp, Homo sapiens
  misc_feature 253, 283: n = A,T,C or G
catgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaaataactcagttatggcatctacccctgctagaaggttacaggngtattatgtagcatgcaatgtggtatgagngcttaataaaaataaaa

SEQ ID NO: 49143 - DNA, 159 bp, Homo sapiens
gacctttaaatttttgccaaatgttatctgaaattgtctatgaataccatctacttctgttgttttcccaggcttccataaacaatggagatacatgcatataggtaaaaaaaaaaaaaaaaaaaaaaaaaaaaaaaaaaaaaaaaaaaaaaaaaaaaa

SEQ ID NO: 49144 - DNA, 137 bp, Homo sapiens
gtgcttcaaataaatagtgtttaaacattgaatgtgttttgtgaacaatatcccactttgcaaactttaactacacatgcttggaattaagttttagctgttttcattgctcaataataaagcctgaattctgatca

SEQ ID NO: 49145 - DNA, 100 bp, Homo sapiens
gccaagtaggaaaggaaaaggcaaatacaaggaagaaaccattgagaagatgcaggaataaagtaatcttatatacaagctttgattaaaacttgaaaca

SEQ ID NO: 49146 - DNA, 300 bp, Homo sapiens
acatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagccctgaataaagataagaagcatcactgaagataatacctggaagcatca

SEQ ID NO: 49147 - DNA, 367 bp, Homo sapiens
ggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgc

SEQ ID NO: 49148 - DNA, 115 bp, Homo sapiens
  misc_feature 39, 65: n = A,T,C or G
aggatgctgaaagctatgttactattcttagtttgtaanttgtccttttgataccgtcatcttgnattctttttgtaggtataaataaaaacactgttgacaataaaaaaaaaaa

SEQ ID NO: 49149 - DNA, 141 bp, Homo sapiens
agaagataaaaacatacttttagaagaaaaaagataaatttaaacctgaaaagtaggaagcagaagaaaaaagacaagctaggaaacaaaaagctaagggcaaaatgtacaaacttagaagaaaattggaaaaaaaaaaaa

SEQ ID NO: 49150 - DNA, 214 bp, Homo sapiens
gggttatgaagaagtctgaagaacgccttgatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaa

SEQ ID NO: 49151 - DNA, 289 bp, Homo sapiens
acaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaa

SEQ ID NO: 49152 - DNA, 300 bp, Homo sapiens
gtaggactgtcttcccaagccccatgttcatggtggggcaatggttatttggttattttactcaattggtactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggaacagttattctgtgtataaaactatacccactgcaaaagtagtagcaagggctaggctttgatatgctcttttgggtaacactaag

SEQ ID NO: 49153 - DNA, 330 bp, Homo sapiens
cttattcgggtgtgagtcttttcagcaacccggccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacctattatgcataaagccaaatttccagttaagtaattgcctacaataaaaagaaattttgcctgccaaaaaaaaaaaaaaaaaaaaaaaaaaaaaaaa

SEQ ID NO: 49154 - DNA, 218 bp, Homo sapiens
  misc_feature 183: n = A,T,C or G
agggaggagtcatcttaccacatttagtaattaaaaccacatggtgttgtgcaggaattcacagaccactgaggaaaaaaaaataaggcacttagaaacatgccagtgtacacatacaaaaggttagtatataatacggttggtgtttttttttttaaaggcagtaggaaatatttaaagttnaataaattattccagctactcttttggaaaaaaaa

SEQ ID NO: 49155 - DNA, 424 bp, Homo sapiens
gctgaaaagatctggacctgatgaaccccaaatatgaatcaaccaaattcctttttatgacagagtcccacactgaggaggtaactgctggaagtaaagtctacattgagaaacaggcatatagggccaaggaaagaaatagtcagataacaaatgggggaaggaagcagaagaggcatagctcagaaaatagccatatttttgaatacttcatgctaacaacagaagagataaccctagagctatgaagctaggaaagctttattggcccattccatccatttttttcacatgagaagcaagataagactatggtcacattccatagttgttattgtaagataaaagagaataatggagagtaagtcttccagaaaagaaagcatgcccacaaagcatatgaaaaatttaacctaatatttta

SEQ ID NO: 49156 - DNA, 300 bp, Homo sapiens
  misc_feature 210, 265: n = A,T,C or G
cctgtagcggattccgtaatacctccccctacccaaaactatgagcctaagttcatttccaggccttgctatgtgtgcttgctgaattggatacaatttcatagaagccttaaaaagtctctgagttataatatttctgttatcaaatgtagcatttgattaaaaaaatgacacttccactacagtccatgtactagttttcttcatggncaagcaaatccttgctctgggcggagaactctactaagagactatttattttggnaaaggtaaacgttcttagcaaaaaccgagaagcct

SEQ ID NO: 49157 - DNA, 243 bp, Homo sapiens
ttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaaaaaaaaaaaaaaaaaaaaaaaaaa

SEQ ID NO: 49158 - DNA, 326 bp, Homo sapiens
cctgtgcacagattcacaaggacttaatctgggttgccgcgggaccctgtcagatgagcatgctggagtgatatctgttctagcccagcaagcagctaagctaacctctgaccccactgatattcctgtggtgtgctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcatta

SEQ ID NO: 49159 - DNA, 340 bp, Homo sapiens
atatatactgtacattctatttaagggaagtagaatcatcctaatcatattacatcaatgaaaatctaatatggcaataaaaatcattgtctacattaaaacttcttagttcataaaattatttcaaatccatcatctctttaaatcctgcctcctcttcatgaggtacttaggatagccattatttcagtttcacataagaaatgtttactcaatgtttaagtgttttgccccaaaattcacaactaacaaggcagaactaggacttgaacatggatcttttggttcttaatccagtgagtgatacaattcaatgcactcccctgcaaaaaaaaaaaaa

SEQ ID NO: 49160 - DNA, 429 bp, Homo sapiens
tgtagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgcaatatgaaggtaaggaacaaaatcagaatctataagtatttcatatgtcactgttaaaacaacatcaatggtgaataccattgagcaataaaaaggaatattgataaactcaagaacatggataaatctttaaaatattatgctgagtgaaagccttactcaagagtatgtacat

SEQ ID NO: 49161 - DNA, 256 bp, Homo sapiens
  misc_feature 37, 224: n = A,T,C or G
ccaacaaaaaaaatttaactccatatgtgttcctctngttctaatcttgtcaaccagtgcaagtgaccgacaaaattccagttatttatttccaaaatgtttggaaacagtataatttgacaaagaaaaatgatacttctctttttttgctgctccaccaaatacaattcaaatgctttttgttttatttttttaccaattccaatttcaaaatgctcaatggngctataataaataaacttcaacactctttatg

SEQ ID NO: 49162 - DNA, 221 bp, Homo sapiens
cgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtg

SEQ ID NO: 49163 - DNA, 300 bp, Homo sapiens
  misc_feature 249, 290: n = A,T,C or G
agtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactgggcagcttggnggcaagtgaatttgcctgaacaagccagattttttaaaaantatattggaa

SEQ ID NO: 49164 - DNA, 281 bp, Homo sapiens
ttgtgcacataggtagtaaaactaaaggagcaaaaggaatgatcacagaagtcagattagtgttccatctggtggtaggagagggacaatgaacttggaggaacatatggaggacttcaattattggcaacattctatttcttaatctgttgctgatctgattgttccctttataattattatttaaattgtacatatgcttttagatacattttttgtgagcaggtaatagaaactaaactgaaacaagtagaagaaaaaaaaaaaaaaaaaaaaaaaaa

SEQ ID NO: 49165 - DNA, 340 bp, Homo sapiens
actacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactg

SEQ ID NO: 49166 - DNA, 300 bp, Homo sapiens
  misc_feature 233, 241, 283, 295: n = A,T,C or G
ctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagcagaaaattcacaagtcagcttctcgatcaaggtacctctcaatgntatgatgnattatcttctgatgggcagaaaaacgccttagcagcctgtgngaggctcggagnagggg

SEQ ID NO: 49167 - DNA, 345 bp, Homo sapiens
ttggagagtccatggatggtggttttcagtttagctacggcaatcctgaacttcctgaagatgtccttgaggtgcagctggcattccttcgacttctctccagccgagcttcccagaacatcgcatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtag

SEQ ID NO: 49168 - DNA, 399 bp, Homo sapiens
agagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgacattgcctgttctgcttcgaagtattcaataccgctcagtattttaaatgaagtgattctaagatttggtttgggatcaataggaaagcatatgcagccaaccaag

SEQ ID NO: 49169 - DNA, 300 bp, Homo sapiens
  misc_feature 29, 38, 155, 169, 182, 208, 244, 277, 292: n = A,T,C or G
acgaaaggcggcaaaaagggagccaagangaaagtggntgatccattttctaagaaagattggatgatgtgaaagcacctgctatgttcaatataagaaatattggaaagacgctcgtcaccaggacccaaggaaccaaaattgcatctgatggnctcaagggtcgtgngtttgaagtgagncttgctgatttgcagaatgatgaagntgcatttagaaaattcaagctgattactgaagatgntcagggaaaaaactgcctgactaacttcatggnatggatcttacccgngacaaaat

SEQ ID NO: 49170 - DNA, 359 bp, Homo sapiens
gctgaaatatccctttggggactgcatatgctgtacatggccacagcatcggagcacggagacttccccggaggtgctgcctcagtgtgcgttgtcagcattgtttagaaatgcaggatcctgtgtcagtttctgaatgccagtcacttcccatttgctgctccgctttttggacactagcactgacagggttggaagagtaaaattaggataccctaggatccacccatctttcaggtttgcttggtgctggctgaaaaatgacttaatattctttctggggcttgtcaaagagtcctgtccgttcttctcctaagccaacccactttaccaggagtaaagccctagctgttgaagga

SEQ ID NO: 49171 - DNA, 263 bp, Homo sapiens
aaagaaagaagtattccaggcagagtgatgcaaccatagctctaccaatagggagaaggttgcctgcaggaaaatggcagacggtgaggtaaacatagaaggatctccatatatcaaatttgcaacttggtgttggaaatgattatatttcaaagacactggtatagatttaaaagaaaaatatctaggtctttgtgttactgattgcattaatccgtctcatgctgctaatagagacatatccaagactgagtaatttacaa

SEQ ID NO: 49172 - DNA, 313 bp, Homo sapiens
tatttagtaaatcagatctcaaaataataaaagactttcggtataataaattcaatattctttaaggaaactattagaagtgtgtttagtgttttgaattttagcaaaatttgtattggtatttatgtatttacatattttctattaatgtataaaaactggttgattgcatttctcttttattgagtagttattttattctcaaatattttttaaaaacttagatgaattagattgcttctaattgctgctgttagtattggctacaattagaatgggaccgaagcttttatgaataattatatattaaaat

SEQ ID NO: 49173 - DNA, 299 bp, Homo sapiens
ctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgaaaaaaaaaaaaaaaaaaaaaaaaa

SEQ ID NO: 49174 - DNA, 300 bp, Homo sapiens
cagaggtcgatggatcgaaaccatcctctgctaggtgcctgttttcttcctccaaaacactgcatcttgcacttgttagaggtgctttaacacctctcatgaatgactgaagacctacagtgaccgagggagtaaactctgttttaactgcctggtgctttctgaaacctagtggttcactttcaaagaacggaagcataagcggagaaatgagtgaatctgcaaatgggaggctgaaaaataaggcggtagaggagcagagaccggtgtgaagaagggaaagactgaggaaagaggtga

SEQ ID NO: 49175 - DNA, 297 bp, Homo sapiens
ggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattcatttaaaaaaaaaaaaaaaaaa

SEQ ID NO: 49176 - DNA, 292 bp, Homo sapiens
tcctgtcatgttacattgctgatattttgtattatactagacatgactcattttaaatacataattgtatatgaagttctcaatgttaatgtctggaggatacagaatcaaaacagaagaaaagttaaaaaattaaaagtaaactatattttgcatatgaataagaatattacaaataccatatttatatactatgtttatgtatctttacactatgcctggcaacaagagcgaaattccatctcaaaaaataaaaaataaaaaaaataaaaaaataaaaaaataaaaaaat

SEQ ID NO: 49177 - DNA, 314 bp, Homo sapiens
ataaagtattgatctaagagaactctccctgtgccccttggtctttattctcaattaagaaaaacagtcacatgtcacgacaaatcaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttca

SEQ ID NO: 49178 - DNA, 186 bp, Homo sapiens
tagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaaaaaaaaaaaaaaaaaaaaaaaaaaa

SEQ ID NO: 49179 - DNA, 300 bp, Homo sapiens
  misc_feature 239, 251, 258, 288: n = A,T,C or G
aggttagcataccgtatcaaggacagtaactaccatggcttccgaagttttgccaaaacctcggatgcgtggccttctgccaggcgtctgcgaaatcatatggctgtagcattcgtgctatccctgggggttgcagctttgtataagtttcgtgggctgatcaaagaaagaaggcatacgcagatttctacagaaactacgatgcatgaaagattttgaggagatgaggaaaggctggnatctttcagagnggaaagnaatcttggaatataaagaatttcttcaggntgaattacctag

SEQ ID NO: 49180 - DNA, 302 bp, Homo sapiens
aatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtt

SEQ ID NO: 49181 - DNA, 265 bp, Homo sapiens
aggggaatgcacctttttccctttccttctcacttttgcatgtttttactgatcattcgatatgctaaccgttctcagccctgagccttggagaggagggctgtaaccgccttcagtcagtctctggggatgaaactcttaaatgctttgtatattttctcaattagatctcttttcagaagtgtctatagaacaataaaaatcttttacttctgaaaaaaaaaaaaaaaaaaaaaaaaaaaaaaaaaaaaaaaaaaaaaaaaaa

SEQ ID NO: 49182 - DNA, 300 bp, Homo sapiens
cgagcagatttttaggtctttcgggggacagtaaattccgggaaattcaacaggagctttccagtggaaggaatgaaggccagctgaatgggtgaaacaaatacacccattgaaggaaaccaggcgggtgatgcagttgcctctgcaggagtctaccaaatgaagaaatagtgcagaagatagaggaagtactttctggggtcttagatacagaactacgatataagccagacttgaaagagggctccagaaaaagtagatgcgtatctgtcaaacagatcctactgatgaaattcccac

SEQ ID NO: 49183 - DNA, 281 bp, Homo sapiens
ttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatcttgg

SEQ ID NO: 49184 - DNA, 382 bp, Homo sapiens
gagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggaga

SEQ ID NO: 49185 - DNA, 243 bp, Homo sapiens
catctggaataatacttgaaattttgatttttggaaaaaaaagttttttatcttttgttgaaatcacctgttatccttgtttgtaaactgataacttttttgcttcttctcaggaatacagttttcaactgttgtcttgttcttgatagaaactgagaagcagcaatctgtatttgtggaggaaagtcctctcttttgcatattctaataaatgagccgcgtttgctcctcaaaaaaaaaaaa

SEQ ID NO: 49186 - DNA, 237 bp, Homo sapiens
caatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaacccaaaaaaa

SEQ ID NO: 49187 - DNA, 284 bp, Homo sapiens
aagcatagcagagtatgactgacaactttacatgaattttttagacataatggtaaacaaaaattcagcctaattattagctgtgctttcttggataagttatttagattctctaagctgttgtctcacaagtaaaatggagatatgtctgcctcataggctattaagaggatagcattctcatacagcagtgttacaaatgatgtatcataaaataatagtccaaccacctgccacatttcagaaacaaaaaaagatttatactttacatgcaatagacatac

SEQ ID NO: 49188 - DNA, 300 bp, Homo sapiens
  misc_feature 133, 135, 146, 247, 264: n = A,T,C or G
accgtatgtgtactgattgacaagttcctgctgtcatgtacttgatggctaaaagacagcaattctcaaagttttcagcttctatcctgacaaattgaaaattttctgaactcattatagaatctactcaagngnacatatgcagncataggtttctgatcttcagatttattaagagccctgaaatctttcttagtaaatattgtatttgaaagagatggctggacgtgggcaagtgctttatagntaacacacatctgaggnccaaaacctgtgtgaggaaggaagaagtggactctt

SEQ ID NO: 49189 - DNA, 371 bp, Homo sapiens
ttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagag

SEQ ID NO: 49190 - DNA, 300 bp, Homo sapiens
  misc_feature 32, 237, 262, 282, 290: n = A,T,C or G
gaagaagataagaaagaaacagaggacaaaanaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggctgnatttattttcaaatggctttttcgnttttggttttcttggcaagntttattgngagtttttct

SEQ ID NO: 49191 - DNA, 314 bp, Homo sapiens
tttaaactgtggcaattaaaggcatgtttatacatgacttaatcgtgaaatgtttgtcactcttactgcacagacttatctgcaatcataactggtagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactga

SEQ ID NO: 49192 - DNA, 260 bp, Homo sapiens
actaacatttataccaaattgcagattattctgcagagagggaattgcatgtttgtgttgtatatttagtatgaactttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttaaaaaaaaa

SEQ ID NO: 49193 - DNA, 360 bp, Homo sapiens
gaacatggacatgagcatgggcatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtgggttcttaactctccaaaataagatttcttctctgtagcctacttg

SEQ ID NO: 49194 - DNA, 300 bp, Homo sapiens
ggccctgtttgctttttataaaccaaactctatctgaaatcccaacaaaaagaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 49195 - DNA, 300 bp, Homo sapiens
gatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagt

SEQ ID NO: 49196 - DNA, 282 bp, Homo sapiens
ctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctggggcttaataatcatagtaacaacaataatacctttttctccattttgcttgcaggaaacataccttaaggttttttt

SEQ ID NO: 49197 - DNA, 300 bp, Homo sapiens
  misc_feature 33, 153, 157, 205, 227, 249: n = A,T,C or G
attccccagtttgtcttcagtgtgacctgaagntgctgaaataagaggttccaatcagcgcaccgccacataccaattcagtatgcaaatagcataaagagggctggcgtggtggctcgcacctgtaattccaacactttgggaggctgaggntggnggaccccttgaggcctttaggagtttgagaccagcctggcaacatggngaaaccctgctctgctaaaagnacaaaaattagctgagtgtggngacgcacacctgtaatcctagctacttgggaggctgaggcataagaattgc

SEQ ID NO: 49198 - DNA, 319 bp, Homo sapiens
gatggtgctagaagaatttgagaagaaatactcctgtattgagttgtatcgtgtggcgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggtttcgaaa

SEQ ID NO: 49199 - DNA, 364 bp, Homo sapiens
accgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgcagtgccggccgggagaaggcagttgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgg

SEQ ID NO: 49200 - DNA, 332 bp, Homo sapiens
tctgccttctttcggaagcgatttcctacttgttttccttctttaaaaactgtcctcgttgttgccttatatattaattccgtcaaggacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcagttgagtaaagaaggacaaagtttgccttaccatatgtttcctgatcgtgcgaaagcc

SEQ ID NO: 49201 - DNA, 300 bp, Homo sapiens
caaaaggtaatgttgcctggggcttaacccacctgccctttgggcaaggttgggacaaagccatctgggcagtcaggggcaaggactgttggaggagagttagcccaagtataggctctgccagatgccatcacatccctgatactgtgtatgctttgaagcaccttccctgagaagggaagaggggatctttggactaggtcttggctccagacctggaatccacaaaagccaaaccagctcatttcaacaaaggagctccgatgtgaggggcaaggctgcccctgcccagggctcttc

SEQ ID NO: 49202 - DNA, 155 bp, Homo sapiens
aaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgcca

SEQ ID NO: 49203 - DNA, 315 bp, Homo sapiens
tcttatcacaaaggaaagaatctagattgttctttgttttcaatcatttgtaatttctaaatttctcttatgaaaatatgcaaatctaataatagcattctgagtaattgaaacaagtgaaaataaaggacacagtatgtcaaggaagaaccacttttattgggtggaataaagtactactgataaaatttattaggcactcatttcaagaatagaatctcggttgctctgtgtaagaatgaataaacataacaacttacttggctctgtacccagaaatttacccaaaaaaaaaaaaaaaaaaaaaaaaaaaaa

SEQ ID NO: 49204 - DNA, 300 bp, Homo sapiens
  misc_feature 69: n = A,T,C or G
ttgacggcatcccaccgcctacgacaagaaaaagcggatggtggtcctgctgccctcaaggtcgtgcgnctgaagcctacaagaaagtttgcctatctggggcgcctgctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacgcagaggtcctcaagacccacggactcctggcttgagccc

SEQ ID NO: 49205 - DNA, 256 bp, Homo sapiens
aacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagtctactcagtgaatgtggattacagcaagctgaagaaggaacgtccagatttctaaatgaaatg

SEQ ID NO: 49206 - DNA, 282 bp, Homo sapiens
cacaatcatggtggacagcaaaggaggagaaaaggcacatcttatatggcagcaggcaagagagcttgcacaggggaactcccttttataaaaccattagctcttctgagacatactcactatggacaagaacagcatgggaaaacccacccccattattcaattacctcccatcaggtccctcccatgacaggtggggattatgggagctataattcaagatgagatttgggtggggacagagccaaaccatatcaccacctaagtctctgtaaaaaaaaa

SEQ ID NO: 49207 - DNA, 326 bp, Homo sapiens
ggctttcattggaatggcataattttttaatgaccagactgctttgaggatttgaagttgactttatagagcctataaaagcctgttggaaaaattagcctgataccttgtctacacagtttccttacaaggttcctgaccttgcggtagtaaagaatgtcactctctggcaggcccaggagcctcaggatattttgggaaccttgacaagagaggagtgtatccaatttatacaggaattacaagtgcagctgattgtgaatccttgcttgcttcttagccttgagagttttaaaagttgaatgtgaaattccttatgaaaaagt

SEQ ID NO: 49208 - DNA, 135 bp, Homo sapiens
  misc_feature 21, 68: n = A,T,C or G
caatgtttgtcattttgaaanacttaatgccaagtaacaatgcatgctttggaaatttggaagatggntttattctttgagaagcaaatatgtttgcattaaatgctttgattgttcatatcaaaaaaaaaaaaa

SEQ ID NO: 49209 - DNA, 311 bp, Homo sapiens
atttgtgtatctagacatagaaaacatacagtaagaatatggtattataatcttacgggaccactgtcaaatacgcggtctgtctttgaaaagttgtaatgcggcgatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtg

SEQ ID NO: 49210 - DNA, 172 bp, Homo sapiens
tgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtt

SEQ ID NO: 49211 - DNA, 318 bp, Homo sapiens
cacctttgcaaattcagtgccaagcatgaagctgggtacacattcaaaaaaagtgtgttcaaagaatgccttttaaagtagctgtaagactatgtggcatgctggtccttgatgatatagggcagacagtgtaaacatggccttacctcctaatgcttatgacctgatgaaaataagttagacattttataatggaaattataaatttatttactcatattcatttcctgaggctctgtacatatttggtacaatgggggtatttaaaaagacaagtgtctgtcctttagcattccaaagagttagaggacaaaactg

SEQ ID NO: 49212 - DNA, 260 bp, Homo sapiens
  misc_feature 88, 105, 109, 128, 133, 205, 208: n = A,T,C or G
caaaacgtatttattgccaaactatgcttttttttgttaattttgttcatatttatcgggatgacaaatccatagaatatattctttnatgttaaattatgatcntcanattaatcttaaaattttgngacgngctttttcctttttttccacagttttaatatattattcttcaacgacattttttggaactttacactttttnggntattttattttaaaaaaatgaaaaattaatttaaaaaaaatgcaaaaaactg

SEQ ID NO: 49213 - DNA, 146 bp, Homo sapiens
cattaacttggatccacttacagaaactgtatccttttttacaaaaaaaaaaagttgattgaagatttactgagaataaagaaaacagaaatgaaaggaaaacagaggagtactgaaaagtttaaaaacttgtaggtcaggaaaca

SEQ ID NO: 49214 - DNA, 222 bp, Homo sapiens
ggccgggatcgctatgatgaccgaggcagcagagactatgatagaggctatgattcccggataggcagtggcaagaagagcatttggcagtgggtatcgcagggatgatgactacagaggaggcggggaccgctatgaagaccgatatgacagacgggatgatcggtcgcggagctccagagatgattactctcgggatgattataggcgtgatgatagagg

SEQ ID NO: 49215 - DNA, 300 bp, Homo sapiens
tctataaaagcttttgtggaaatggctagagctagggtaaggaaacaaatttggttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaatgattaaatacccaatgatgtaaaaaacatttataaaataggaaagtaagactgactcaaccataatttgttgagcaacccaaaaatc

SEQ ID NO: 49216 - DNA, 298 bp, Homo sapiens
aagaaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagtttcagtg

SEQ ID NO: 49217 - DNA, 198 bp, Homo sapiens
gcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaa

SEQ ID NO: 49218 - DNA, 419 bp, Homo sapiens
cactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaataaaaaaaaaaaaaaaaaaaaaaaaaaaaaaa

SEQ ID NO: 49219 - DNA, 299 bp, Homo sapiens
  misc_feature 268, 271: n = A,T,C or G
attgcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgnggngcttttatatttgaattagtaactgtat

SEQ ID NO: 49220 - DNA, 339 bp, Homo sapiens
gctttggtacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagt

SEQ ID NO: 49221 - DNA, 449 bp, Homo sapiens
aatggaccaatagttcctaaattagtaataaggcttaccttacaaaagtaatgaaataacactgatatttctctttcaaaggctaacagcaattcttggtcctgagctattcagttcatacaataactactgtacatgctacaacatctgaatattaatggttttgctgcagattctgggtatgaggattagcttgaaagcaatacatttgctaacatgaatcatgactcacattatccccgtgtgctttactacctgtatatgaatgcaaatgttgttacagaaaatatgcttgaaatgtcaatacagtgtgcaattagcgttgcattgcatgctccagcatgtgatatctgtatggtgaagttatttcaattactctgatacattactataataaaaaaggttaacctaagaaagccaaaaaaaaaaaaaaaaaaaaaaaaaaaaaa

SEQ ID NO: 49222 - DNA, 373 bp, Homo sapiens
ggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagggcagacagaaaaagatttgaagagacgggtcaggaactagcggaattactggaggaagaaaaactaagttgtgtgccagtgctcatctttgctaataagcaggatttgctcacagcagcccctgcctctgaaattgcagaa

SEQ ID NO: 49223 - DNA, 414 bp, Homo sapiens
aacagaaaagagaacccagaaataaagccacatacctacaactatctcatcttcaactaaggtgacaaaaacaagcaacagggcaaggattccctattcaataaatggtgctgggacaattggctatccttttgtagaagaataaaaatggatccctatctttcatcatatacaaaaaattaactcggccaggcgcggtggctcacgcctgtaatcccagcactttgggaggctgaggcaggtggatcacgaagtcaagaaatcaagaccatcctggccaacatggagaaaccccgtctctactacagatacaaaattagccaggcatggtggcacgcgcctgcagtcccagctactcgggaggctgaggcaggagaattgcttgaatccgggaggtggaggttgtagtgagcc

SEQ ID NO: 49224 - DNA, 310 bp, Homo sapiens
agacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttg

SEQ ID NO: 49225 - DNA, 312 bp, Homo sapiens
acagggatgttgtgaggataaatgtgttcgtgtaagaaagaaattatataaaacctcaaggtattatttttgtggtggtgttactaaacaaatataaaaattcaacaaaaatagtgctttggattttggtacatttgttaaaaataactttgggcatttggttaggatatgaattagagtggagttagctcattttgaattatatatgacagtttagttcattgcctatttttaagataaacaaaaggaatttgccaagaagtcataagttgttttttaaatctgtatgtttactgaaaatctttcttgaga

SEQ ID NO: 49226 - DNA, 329 bp, Homo sapiens
gtcagactccagcagccaagatggagaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaa

SEQ ID NO: 49227 - DNA, 300 bp, Homo sapiens
  misc_feature 24, 36, 228: n = A,T,C or G
cacccaggctggagtgcagtgggnggtgatctcggntcactgcaacctccgcctcccaggttcaaacgattctcctgcctcagcctcccgagtagctggaattacaagtgcccatcaccatgcctggctaatttttatatttttaatagagacggggttttgccatgttggcaaggctggtcttgaactccagacctcaggtgatctgcctgcttggcctcccaaagngctgggattacaggcatgagccactgagctcagcatttcttttaaaactctgctgcttgttaattttattgg

SEQ ID NO: 49228 - DNA, 274 bp, Homo sapiens
catagatgagagtaggcaaccaagaattaccacacatccaaggaaagcacttagtatggaaaataaagactaaacaaaaagaaaaaaagcaacttggaggaaaactgaaactataaagggaagaagaaactttttaattaaagctgttgttaagatcctcagagagataaggcatccatgaaataaaaataagataccattttaaaaggacatcctgaaaatttaaaagagctcttagaaattaaaaatctgatagcagaaaaaaaaaaaaaaa

SEQ ID NO: 49229 - DNA, 420 bp, Homo sapiens
acagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttg

SEQ ID NO: 49230 - DNA, 262 bp, Homo sapiens
aactaccatggcttccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcagg

SEQ ID NO: 49231 - DNA, 189 bp, Homo sapiens
cagggaaacaggtgtcaaatacaaaatttctatggcaggctttatgtgttcaaaccacagcacgtagactaggaagagggggaactatggaaagagtgatagatatgaggtcagaaaggttgtaatggctgaataatatgtgccttggtaggtcatcataagagtgattcccacgttttgtgcctgagc

SEQ ID NO: 49232 - DNA, 250 bp, Homo sapiens
  misc_feature 22, 70, 98, 107, 203: n = A,T,C or G
actgaggctttctgtgcttggnctgactttggctatgctggacctaactttgcgtgtgtgtgtgtgtagnaagggggtcatttctttttgggtaatgngaaagttcntaagagtgcaatggggagggatagagggtgggggctcatggtttccctctactttgggagagggcacagattgcagaggtaatgctggggcatatngcttctgctcaagtgtatcactggagcacaggaccctgcccacctga

SEQ ID NO: 49233 - DNA, 300 bp, Homo sapiens
  misc_feature 95, 144, 205, 227, 230, 270, 286, 289: n = A,T,C or G
cgacccgccacctgccacctctgacggagggggagaagttagtctgtgctaagatagtactgagtccccagatgttgtatactgtaaattacagnataatgccaaatgcagcaaaatcttccagctgtacgttacaagtttggncattttgaagcttgacattttagtttgccattatgttaaaaacatctaaatagggggtagnttctcaggaggagattggtagnggngacttttcctggaaagcagacatcgtcttggcctgcctgnattggatactagattnatnggtggctctca

SEQ ID NO: 49234 - DNA, 340 bp, Homo sapiens
gacaagaaggcgctggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacaggtaacttctacatatcaagtaacacaggatcaaatgaaaacctagcaacacttggtttctgcctgtatcagacaggtgaaattgcaagcagttatacaagtagtgtactaacttctcataaagcctactcaaggagggtattg

SEQ ID NO: 49235 - DNA, 280 bp, Homo sapiens
ccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttgggaaaaaaaaaaaaaaaaaaaaaaaaaaaaaaaaaaaaaaaaaaa

SEQ ID NO: 49236 - DNA, 166 bp, Homo sapiens
  misc_feature 30, 104, 118, 142: n = A,T,C or G
attaagtaataaacacctaatacagtgccngtcatgtagttgcttagcaaatattagttagatgcatgaatgtgtaggtatcaaagattttttttttttcaggngatcacattctagnggaagacactatactgctttatgngataagggcttggataaagaaagc

SEQ ID NO: 49237 - DNA, 304 bp, Homo sapiens
  misc_feature 252, 270: n = A,T,C or G
tgaaatgatatgaccaaaattttaagtaggaaagacacccaaacacttccgctttcacttaagtgtctggcccgcaatactgtaggaacaagcatgatcttgttactgtgatattttaaatatccacagtactcactttttccaaatgatcctagtaattgcctagaaatatctttctcttacctgtatttatcaatttttcccagtatttttatacggaaaaaattgtattgaaaacacttagtatgcagntgataagaggaatttggnataattatggggggggatatttttatactggatg

SEQ ID NO: 49238 - DNA, 228 bp, Homo sapiens
tacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagattttttttttgcaccccatgctgttgattgctaaatgtaacagtctgatcgtgacgctgaataaatgtctttttttttaatg

SEQ ID NO: 49239 - DNA, 300 bp, Homo sapiens
  misc_feature 40: n = A,T,C or G
tgtctggaatatgtttataaaattttagcaaggggtgagntcaagggacaaaggtagagtggttatttaaagacaatcagaaatgaacttaaaagctgccctgcaaaaccaatcctttcctatcatgaagagtaccttcatattttctagagattgtctctgaaccgttgctacatagccataaatttctgtaaatcatgttggctatcagttcttgctattctcagagcactctatcatgtttttaggtgtatattgtgtattcaggatagcattaaaaagaactgatggcaaatgtat

SEQ ID NO: 49240 - DNA, 310 bp, Homo sapiens
aaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctacctgaactgtaaatgttttctgaatt

SEQ ID NO: 49241 - DNA, 283 bp, Homo sapiens
gaaatgatatgaccaaaattttaagtaggaaagtcacccaaacacttctgctttcacttaagtgtctggcccgcaatactgtaggaacaagcatgatcttgttactgtgatactttaaatatccacagtactcactttttccaaatgatcctagtaattgcctagaaatatctttctcttacctgttatttatcaattttcccagtatttttatacggaaaaaattgtattgaaaacacttagtatgcaggtgataagaggaatttggtataattatggtggg

SEQ ID NO: 49242 - DNA, 124 bp, Homo sapiens
tatcgacgcagcgtccccacttggatgaagttgacatctgacgacgtgaaggagcagatttacaaactggccaagaagggccttactccttcacagatcggtgtaatcctgagagatccacatg

SEQ ID NO: 49243 - DNA, 235 bp, Homo sapiens
aagaaaacctctccttttgagctgatacaggttttttccccagaatccttttctggcatgtttattgtatgaaataatgaggctctccatggaaggatgaacacatatgagtcaagggattgcaattctctctgatagacttagttttcagaccttataactattgtatatgcattgaagggtgatatatttgcatataaaaataaatgcacctgctctgggaactaaaaaaaaa

SEQ ID NO: 49244 - DNA, 227 bp, Homo sapiens
agaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacaccaaaaaaaaaaaaaaaaaaaaaaaaaa

SEQ ID NO: 49245 - DNA, 300 bp, Homo sapiens
caatgcaacgggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgttgg

SEQ ID NO: 49246 - DNA, 264 bp, Homo sapiens
ctgttatccctcccagagggaggctgaggctgcagatccctgaggtcaggagtttgagaccaccctggctaacatggagaaaccctgtctctactaaaaatacaaaaattagctgggcatggtggtgcacgcttgtaatcccagctacacgggaggctgaggcagaagaatcgcttgaaccccagaggcagaggttgtagtgagccgagatcgtgccacttgctctccacctgggaaacagcaagactccatctctaaaaaaaa

SEQ ID NO: 49247 - DNA, 232 bp, Homo sapiens
ttcaacctccccagcagtcatttaagacctattactgacagccctgtcctaggagcacaacgtccgagaaatgctcagcttgactgctccaaattggagaccttgggcattggccaacgaacaccatttcgaattggaatcaaagaatcactttggctttcctcattgacaagagatggagacaaacggtctttcattagtttatttgtgttgggttctttttttttttaaa

SEQ ID NO: 49248 - DNA, 165 bp, Homo sapiens
gagtctgcagtgagccgtgatcatgccactgcactccagcctgggcaacagagcaagaccctgtctcaaaaaataataataataataataataattataacttattacatagaagtaaaatataaactagatgtcattaaaaaaaaaaaaaaaaaaaaaaaaaaa

SEQ ID NO: 49249 - DNA, 338 bp, Homo sapiens
ctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatggg

SEQ ID NO: 49250 - DNA, 249 bp, Homo sapiens
aaagtccattaagtaagttgatttgttatttctgtttatctgtaaagaatctcagtgagtttttctctagaaaagacccggatagttacttctggtgccattttcttatacagaaatcatgacagatttttctgtatttatcagtaactgataaactgtaaaatgacagagaaaaggcatctaatatggctaatttctgataattggggcacaaagtatttttaaattaagattttccaaaaaaaaaaa

SEQ ID NO: 49251 - DNA, 170 bp, Homo sapiens
gagacactctgcctctgtccccagtgccccacatatttccagctcacagatacgttttgtttggccttgcgacaattttaaagcttgtaaaataataaagtaatataattttagtaatattaaaatgacattaattaaaattatgtgaacccttaaaaaaaaaaaaaaaa

SEQ ID NO: 49252 - DNA, 334 bp, Homo sapiens
aaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtaggtt

SEQ ID NO: 49253 - DNA, 400 bp, Homo sapiens
gggcaacacaaaaacattcagttcattgaagatgttgaaattgttattctagataattttaaggaaaggaaacaagtagctcttttatccaaactaatgttcaagacatatcagctgggcggataatgcttgagatgatttccttaaaggctactgtgtttggtgttctttaggtaatattaaattttataaaagccaaaagtcctagtgtaatgattttgtctcatttatttttcagctcacttcaagaaatctccatgtatgcacaagtaactcatcagaaggctgaggagatctatagatatatttactatgtatttgacatacaaatgttaccaaatgatcttaaccaagatagactgaaatctgatatataatcaagctgctcaagatggggttt

SEQ ID NO: 49254 - DNA, 194 bp, Homo sapiens
gacaaaggcgctttggctaagctgggggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgt

SEQ ID NO: 49255 - DNA, 292 bp, Homo sapiens
gagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaacgccacgacattattttcagtattgttggtatatttaaattttccttacaataaagcacacttttat

SEQ ID NO: 49256 - DNA, 280 bp, Homo sapiens
atgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttccaaaaaaaaaaaaa

SEQ ID NO: 49257 - DNA, 150 bp, Homo sapiens
cattggagccatcacaagaatgttcatttggaatgaaggctgcaggcactggttgcagacgtctttataggcagtcaccatgttgtcaaaccttaataatgcacctcatgtattagtcacaataaaaatcagaacccaaaaaaaaaaaaa

SEQ ID NO: 49258 - DNA, 353 bp, Homo sapiens
tgaatccttaactaaggttaataacagagtgggagcaggttctggccatgtgccaggcgatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagc

SEQ ID NO: 49259 - DNA, 287 bp, Homo sapiens
acatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtt

SEQ ID NO: 49260 - DNA, 300 bp, Homo sapiens
  misc_feature 48: n = A,T,C or G
ttaaaaatgctgggatggggccatatctacttgcagaggccagatggncagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagagctggcttggctgttccttgttattccgaaagccctggtttggggcccatgttcacactggctctcagtctaagcaggtgca

SEQ ID NO: 49261 - DNA, 351 bp, Homo sapiens
aattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaag

SEQ ID NO: 49262 - DNA, 297 bp, Homo sapiens
gatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggaagacagttcatgcagtatatgaattgacataatggaaataatctgattttatttttacaactaacatccattccccttcatttaaacaccttt

SEQ ID NO: 49263 - DNA, 300 bp, Homo sapiens
  misc_feature 30, 31, 208: n = A,T,C or G
ccattttaagagttacttaatgtttggtannttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggngctttctatcacctcttctaatcttttaatgtatttgtttgcaattttggggtaagacttttttatgagtactttttctttgaagtttaagc

SEQ ID NO: 49264 - DNA, 259 bp, Homo sapiens
taatgaaaaaactttctattaatagttcactgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtattcaaaaaaaaaaa

SEQ ID NO: 49265 - DNA, 120 bp, Homo sapiens
tttgaattaaaaagaaactttttaaacctggcttaagtatgcttgttaacaattggacgatatacagtattaatgaattgccctggatttactagttcccctttacccacccgctccccc

SEQ ID NO: 49266 - DNA, 121 bp, Homo sapiens
cattctatcatcaacgggtacaaacgagtcctggccttgtctgtggagacggattacaccttcccacttgctgaaaaggtcaaggccttcttggctgatccatctgcctttgtggctgctg

SEQ ID NO: 49267 - DNA, 279 bp, Homo sapiens
catttatccttacattttatgcctccccctaaattaatgactgagttgggggaaagcggctaggttttattcatactgttttttgttctcaacttcaaaagtaatctacctctgaaaaatttgtagtttaatatttgtttggtgaatttgtgccactttaatccatccactatcattcccattttgttacatttctgttatggggactttatgttgaaatattgtataaagcatttgtagcaatttaaaaataaaatatttaaaatcaaaaaaaaaaaa

SEQ ID NO: 49268 - DNA, 247 bp, Homo sapiens
gagaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacg

SEQ ID NO: 49269 - DNA, 230 bp, Homo sapiens
atcataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggattttgtttctgtttttatttttaaattaaataaattgcaatgaactgagg

SEQ ID NO: 49270 - DNA, 213 bp, Homo sapiens
aaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataagg

SEQ ID NO: 49271 - DNA, 332 bp, Homo sapiens
gttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccggtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtg

SEQ ID NO: 49272 - DNA, 305 bp, Homo sapiens
atcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggcatgtacattttcatattagactttttgttaaataaacttttgtaatagtc

SEQ ID NO: 49273 - DNA, 108 bp, Homo sapiens
actccagcttgagtcccagatacactcatgggctgccctgggcagccagcattcattgtaagttccctctttgaaaactggtgtgtgggtgttcagttctgtgtctgg

SEQ ID NO: 49274 - DNA, 272 bp, Homo sapiens
agattcagggccaggctgtaagtctagaatttagatatcctgatcccccagataccgctcttctggttatacacagaccagctataatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcataaaaaaaaaaaa

SEQ ID NO: 49275 - DNA, 208 bp, Homo sapiens
ttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacag

SEQ ID NO: 49276 - DNA, 344 bp, Homo sapiens
ttcgtgaaaaccctaacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcg

SEQ ID NO: 49277 - DNA, 359 bp, Homo sapiens
tcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactgctctgcttttaatttaataccagttttcaggaacccctgaagtttaagtcattattctttataacatttgagagaatcagatgtagtgatatgacagggctggggcaagaacaggggcactagctgccttattagctaatttagtgccctccgtgt

SEQ ID NO: 49278 - DNA, 300 bp, Homo sapiens
  misc_feature 46, 53, 143, 152, 157, 209, 221, 245, 263, 274, 287: n = A,T,C or G
agattacccaaaaggagatgcttctactggatggaatacaggtttntggcatnattattgaagactaccaaaataaatgctttaattttcatttgctacctctttttttattatgcctgggaatggtcacttaaatgacattntaaataagntatgnatacatctgaatgaaaagcaaagctaaatatggttacagaccaaagtgtganttcacactgttntaaatctagcattattcattttgnttcaatcaaaagggggtncaatatttttnaggggggtagganactttcttcatag

SEQ ID NO: 49279 - DNA, 246 bp, Homo sapiens
tttgagcatctttgctttcattcgctcccgtctttggttctccagttcaaattattgcaaagtaaaggatctttgagtaggttcggctgaaaggtgtgcctttatatttgatccacacacgttggtcttttaaccgtgctgagcagaaaacaaaacaggttaagaagagccgggtggcagctgacagagggagccgctcaaataccttcacaataaatagtggcaatatatatatagtttaagaag

SEQ ID NO: 49280 - DNA, 300 bp, Homo sapiens
  misc_feature 140, 164, 200, 212: n = A,T,C or G
agctgagtcttgatcattttaagacaacgatgggtagaattttgagattaatgttaattttccctttttgttaatttcagtcccctctcactatgcttttgccagaaggatcaagaattctaccatcccttgggctttgngtataaacaatggtaaataaaggnagactcagctttaagatattaagacagttttttagnccatgggattgnaaatataaacattaactttcctataagaatattttggctttggaatctatagcctcaaatgggatttattatggatcactagacaaac

SEQ ID NO: 49281 - DNA, 236 bp, Homo sapiens
accagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaa

SEQ ID NO: 49282 - DNA, 264 bp, Homo sapiens
aaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgt

SEQ ID NO: 49283 - DNA, 300 bp, Homo sapiens
ccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgccaggtagaaa

SEQ ID NO: 49284 - DNA, 118 bp, Homo sapiens
ggacactaggaaaaaaccttgtagagagagtaaaaaaatttaacacccatagtaggcctaaaagcagccaccaattaagaaagcgttcaagctcaacacccactacccaaaaaaaaaa

SEQ ID NO: 49285 - DNA, 300 bp, Homo sapiens
  misc_feature 254, 256, 292: n = A,T,C or G
tggcctggaggctatccagcgtactccaaagattcaggtttactcacgtcatccagcagagaatggaaagtcaaatttcctgaattgctatgtgctgggtttcatccatccgacattgaagttgacttactgaagaatggagagagaattgaaaaagtggagcattcaagacttgtctttcagcaaggactggctttctatctcttggactacactgaattcaccccactgaaaaagatgagtatgcctgccgngngaccatgtgactttgcacaagccaagataggtaagngggatcgg

SEQ ID NO: 49286 - DNA, 221 bp, Homo sapiens
ataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccatgaaaaaaaaaaaaaa

SEQ ID NO: 49287 - DNA, 300 bp, Homo sapiens
  misc_feature 294: n = A,T,C or G
tgagagcaatgagcattccgatgtgattgatagtcaggatttttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagacatgaaatgcttctttctcagtttattggtngaatgt

SEQ ID NO: 49288 - DNA, 300 bp, Homo sapiens
  misc_feature 284: n = A,T,C or G
atatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctgcccaaggtgncctgcaggctggaatg

SEQ ID NO: 49289 - DNA, 240 bp, Homo sapiens
cctgggtgagctggaacgacttgtccttacaggtgtcactgacattcgaggacgtggctgtgctctttacctgggatgagtggagaaagctggctccttctcagagaaacttgtaccgggatgtgatgctggagaactataggaacctggtctcactgggactctcatttaccaaaccaaaagtcatctccctgttgcagcaaggagaagatccctgggaggtggagaaagacagttctg

SEQ ID NO: 49290 - DNA, 300 bp, Homo sapiens
  misc_feature 191, 193, 204, 219, 248, 263, 265, 277: n = A,T,C or G
tgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgngntactaatttgnataacccatatctgngcaatggaatataaatatcacaaagttgnttaactagactgcgngntggttttcccgnataataaaaccaaagaataggtt

SEQ ID NO: 49291 - DNA, 390 bp, Homo sapiens
ttctgactttttgaagcatgatccccaaagaggtcataatcactcatattttaaaaaccaaaaaaattttcatttttgttaaagtatcccatcaatgaaaataaagttgtacagaggtttgagataaagataaggtattagattttcttcacaatcagcctactagcttgactggctctcttttcccaaaatgacatttcaaactcttttgaaggacaggaagttataaaatgtaaacaattaagaattgtcatactcggttattctacctagtgtcctccagttggtaagcaagaccaaggagtgtgtcgctaagagagagagacactggtatccttcctgttggctactgctcaagttaagaaaatatcttaaaatacgcctaccttt

SEQ ID NO: 49292 - DNA, 300 bp, Homo sapiens
  misc_feature 273: n = A,T,C or G
gttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagngggaatctttattaaaacattcacttt

SEQ ID NO: 49293 - DNA, 239 bp, Homo sapiens
cctttcttagctgatgtctttggccagaacaccgtgggctgttacttgctttgagttggaagcggtttgcatttacgcctgtaaatgtattcattcttaatttatgtaaggtttttttgtacgcaattctcgattctttgaagagatgacaacaaattttggttttctactgttatgtgagaacattaggccccagcaacacgtcattgtgtaaggaaaaataaaagtgctgccgtaac

SEQ ID NO: 49294 - DNA, 276 bp, Homo sapiens
acaactacttaaaaaatatagtcaataggttactaagatattgcttagcggtaagtttttaacgtaattttaatagcttaagattttaagagaaaatatgaagacttagaagagtagcatgaggaaggaaaagataaaaggtttctaaaacgtgacggaggttgagatgaagcttcttcatggagtaaaaaatgtatttaaaagaaaattgagagaaaggactacagagccccgaattaataccaatagaagggcaatgcttttagattaaaatga

SEQ ID NO: 49295 - DNA, 271 bp, Homo sapiens
gattaacaaagcaacctttcccttctcccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacgaataaaatgaaataaaagaaacaaatgaaataaatattgtgttgtgcagcattaaaaaaaatcaaaataaaaattaaatgtgagcaaagaaaa

SEQ ID NO: 49296 - DNA, 355 bp, Homo sapiens
tttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatccgagacatgtaagcagcatcatggaggtttgaagatgccgcatttggat

SEQ ID NO: 49297 - DNA, 370 bp, Homo sapiens
cacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatg

SEQ ID NO: 49298 - DNA, 355 bp, Homo sapiens
tctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagt

SEQ ID NO: 49299 - DNA, 330 bp, Homo sapiens
gagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgacattgcctgttctgcttcgaagtattcaataccgctcagtattttaaatgaagtgattctaagatttgg

SEQ ID NO: 49300 - DNA, 307 bp, Homo sapiens
cctgaggcctagaggcatcggggttgcccaaggtcacacaaagcctgacatgaagacagaagaagaagtagcattagttaattcaaacaagcctgtattgatcttgtaaattggctaaaatctttgttgtactaaagagattgcttaatgtttttgaatcctattctttaaaatgttttgggttgagtaataaagctaaatatcaccagaaagataacttattgaaaattgtaaaagtatttctttgagaagaaatggataaagtattttcaaatagtctcatttacttcctgtaaaacatggtgag

SEQ ID NO: 49301 - DNA, 344 bp, Homo sapiens
gctggaaaataaggatgtgataaatagaaaacaaacaaaagcattgatggggtaattttagaggggtacaaaaaccaataaaacagctcccaatggccaaatcttgaacaatttaaggaacaaactaaaatactactatatcatattccaaaatataaaataaatattaatctgtgctgttgtaaataaatgattaaataaattaacacattggagaaaagagagaaaactcctctgcaggagaattctaaattaattaaattaattaaaacgttgctgattttgaaaatgttatgtaaccttatatacatagaattgtgctttttatattttaatgtattttg

SEQ ID NO: 49302 - DNA, 308 bp, Homo sapiens
tgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgt

SEQ ID NO: 49303 - DNA, 231 bp, Homo sapiens
gaaagcaaagcatttcatcaaaacaaagtattttaaattatgagtgaaaattgtgtatgttaattttgcagctgtaatattaatcaaactttgtgtaattctaatcacaaaatgatgtgccttaaatgcccctccagctgtgggttggcagtgtccagacagggaccctgaaatcctgaatgactgctagaccaattctattaaaaacatttcaaggcaaaaaaaaaaaaa

SEQ ID NO: 49304 - DNA, 280 bp, Homo sapiens
gaccgacgaggatgactagacagcaaaaaaggaaaagttaaactaaaaaaaaaaaggccgcgggacttattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttg

SEQ ID NO: 49305 - DNA, 185 bp, Homo sapiens
gaactgtgcttcaggttgattgttaagtacatatggcctccagttttctcttattttcattcgaatttacataggctaaagctagtgaagtttcagtaggtgtaccgaaagctcagaaatggaattcattttaactcaagccttttaagaaataaatactgccttttagagtaaaaaaaaaaaaa

SEQ ID NO: 49306 - DNA, 428 bp, Homo sapiens
cacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggcaaaaaaaaaaaaaaaaaaaaaaaaaaaaaaaa

SEQ ID NO: 49307 - DNA, 334 bp, Homo sapiens
aactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataact

SEQ ID NO: 49308 - DNA, 300 bp, Homo sapiens
  misc_feature 31, 279, 291: n = A,T,C or G
cagattggggaaaatgaagcagcccactgantaattgacaaagtctgcttggagaacattctaaggtacaatatcatggagctcctttttcctttctccactaattgcgtgatgagctattgttctggctggtaattctccaactcggctgtcatttgaagtggcagacttaatatggaaggtttttataattatgagtttgaaaaagcattttaagatgatacagaaagtatccaaaacaacagaaaaaaaaagccacgcattttagatgaattgcgnccttaaaatggngacggtaga

SEQ ID NO: 49309 - DNA, 160 bp, Homo sapiens
acaagatgttttctctttgaaagatagagattaatacaactacttaaaaaatatagtcaataggttactaagatattgcttagcgttaagtttttaacgtaattttaataagcttaagattttaagagaaaatatgaagacttagaagagtagcatgagg

SEQ ID NO: 49310 - DNA, 404 bp, Homo sapiens
aatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaa

SEQ ID NO: 49311 - DNA, 241 bp, Homo sapiens
gtaaaatgggggacccttactgcattatcaagggaaaggcaagactgggacgtctagtccacaggaagacctgcaccactgtcgcttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaag

SEQ ID NO: 49312 - DNA, 197 bp, Homo sapiens
ttttaaagaattagaaaagcaagaataaaccaaacccaaattagtagaagaaaaagcaataatgaaagatcagggcagatacaagttaaactgaaaataaaacaacaaagatcaacaaaagaaaaagttgattttttgaaaagttaaacaaaattgacaaacctttagccagactaaggaaaaaaaaagaagacccc

SEQ ID NO: 49313 - DNA, 188 bp, Homo sapiens
aaaaccactatagaactgaagaaataaaattatatgggttaactaaagcagcaccttagtactttagctagagataaatttttatcattaaagatgaattttaaaaacaaggaacattgaaaataaatgtgttgaatgttcaactaaagaagcttgtaaaagaataatagaataaacccaaaaaaaaa

SEQ ID NO: 49314 - DNA, 363 bp, Homo sapiens
ttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgcatgacaaggaaacttacaaactgcaacgcagagaaactattaaaggtattcagaaacgtgaagccagcaattg

SEQ ID NO: 49315 - DNA, 302 bp, Homo sapiens
aaatttcccagtttttcattttaagatttaatgattttctttactaataataacctatatgctatgatttgtaacttgcattttacaaagcaagttaaatgtggaacttgtgcgtttgtttaccttaggattaggctttactggcatcacagcatttttcagtaattactagatttcttagcatcttggatttcattgaaaaatgctcgttcagaagtaatgtatgaaaggacttgcagatacaatataaaaagtgagaaatcagggattgtgaaggtttttattcccaaaaaccttgctag

SEQ ID NO: 49316 - DNA, 300 bp, Homo sapiens
ggagggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggcattttaaatgaatctggggaaggaagtgcgctggagaaatccttagctgtcagccaaggtggagagctctatgaagagtggctgggaacttagaaacggttgcctctgctgtcaagtgaaggaca

SEQ ID NO: 49317 - DNA, 316 bp, Homo sapiens
catgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctg

SEQ ID NO: 49318 - DNA, 148 bp, Homo sapiens
gtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttgg

SEQ ID NO: 49319 - DNA, 300 bp, Homo sapiens
  misc_feature 227, 245: n = A,T,C or G
aatcctgagaacctggccaccctggagcgctatgtagagacgcaggccaaggaaaatgcctatgatctggaagccaacctggctgtcctgaagctgtaccagttcaacccagccttctttcagaccacggtcaccgccagatcctgctgaaggccctcaccaacttgccgacacagacttcaccctgtgcaagtgcatgatcgaccaggcacatcaagaagaacggncaatccgacagattttgnacctcggggacctgctggagacctgcatttccaggccttctgcaagccctggatg

SEQ ID NO: 49320 - DNA, 287 bp, Homo sapiens
cctgcctcagcctcccaaagtgctaggattataggcatgagccacccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatt

SEQ ID NO: 49321 - DNA, 294 bp, Homo sapiens
  misc_feature 64, 131, 231, 235, 268: n = A,T,C or G
gagtcttacagcctggtccattctggaagaactcctagaaaaagacaggcaaaatcgacttggngccaaggaagactttcttgaaattcagaatcatcctttttttgaatcactcagctggctgaccttgnacaaaagaagattccaccaccatttaatcctaatgtggctggccagatgatatcagaaactttgacacagcatttacagaagaaacagtccatattctgngggnggatcttctgactattctatagggaatgccagngaattggagggcagatgatgcattcg

SEQ ID NO: 49322 - DNA, 318 bp, Homo sapiens
gaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtag

SEQ ID NO: 49323 - DNA, 300 bp, Homo sapiens
  misc_feature 240, 249, 251, 284: n = A,T,C or G
tgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatgggnaatcggatntnagaaaccagcttcaccggatatgtatgaatgtntacgtgtggtaacgaa

SEQ ID NO: 49324 - DNA, 168 bp, Homo sapiens
  misc_feature 26, 29: n = A,T,C or G
agcttgaggaaaccgcagataagttnttntctctttgaaagatagagattaatacaactacttaaaaaatatagtcaataggttactaagatattgcttagcgttaagtttttaacgtaattttaatagcttaagattttaagagaaaatatgaagacttagaagagt

SEQ ID NO: 49325 - DNA, 217 bp, Homo sapiens
gagggcatactaatttgcaagaagtgaactttgcaataaatgaattttaaatctagtaaaatttttgtcattttcatttataatatatatttgtgacataatttcttcctttaaactgaaaattcttttacgactccagccatacagctaactggaagtatcttattttactagaaaaatttttacttaaaaaaaaaaaaaaaaaaaaaaaaaaaaa

SEQ ID NO: 49326 - DNA, 300 bp, Homo sapiens
  misc_feature 124, 261, 273: n = A,T,C or G
gggagacgcatataatatgaggcatccacttactggtggaggaatgactgttgcttttaaagatataaaactatggagaaaactgctaaagggtatccctgacctttatgatgatgcagctatnttcgaggcaaaaaatcattttactgggcaagaaaaacatctcattcctttgcgtgaatatccttgctcaggctctttatgaattattttctgccacaagatgattccctgcatcaactaagaaaagcctggtttctntatttcaaactnggtggcgaatgtgtgcgggtcctgttg

SEQ ID NO: 49327 - DNA, 180 bp, Homo sapiens
gttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcaaaa

SEQ ID NO: 49328 - DNA, 300 bp, Homo sapiens
  misc_feature 226: n = A,T,C or G
gactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttntaagttctgctaaatcacatctgcctcatagagaaaggaatgttgcctttgagaactgtcttggagaacagata

SEQ ID NO: 49329 - DNA, 193 bp, Homo sapiens
ctcaatggatctagaacttcatcgccctctgatcgccgatcacctctgagacccaccttgctcataaacaaaatgcccatgttggtcctctgccctggaccagggacattctggactatttctgtgtttatttgtggccgagtgtaacaaccatataataaatcacctcttccgctgttttagctgaagaatt

SEQ ID NO: 49330 - DNA, 347 bp, Homo sapiens
cagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatacta

SEQ ID NO: 49331 - DNA, 300 bp, Homo sapiens
acaagaggtgctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgcattctagatgttctgttgcagtatcaaaaccggcttccaggctgcacggcaagcgagcacagctccgtgccaaagctaactaatttgctaatcactgattttgcaaagcttggttgtgga

SEQ ID NO: 49332 - DNA, 300 bp, Homo sapiens
  misc_feature 242, 298: n = A,T,C or G
agatcaccaatgcttgctttgagccagccaaccagatggtgaaatgtgaccctcgccatggtaaatacatggcttgctgctgttgtaccgtggtgacgtggttcccaaagatgtcaatgctgccattgccaccatcaaaaccaagcgcagcatccagtttgtggattggtgccccactgcttcaaggttggaatcaactaccagcctcccactgtggtgcctggtggagacctggcaaaggnacagagagctgtgtgcatgccgagcaacaccacaagcattgctgaggcctggctcngc

SEQ ID NO: 49333 - DNA, 347 bp, Homo sapiens
cacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatcctcattctatttataacttaagatgataaggcactataaattaatgacctaaaataatatatttg

SEQ ID NO: 49334 - DNA, 183 bp, Homo sapiens
  misc_feature 21, 24, 88, 96, 101, 119: n = A,T,C or G
ttagttgaaactggtatatanaantcagtgcttggcaggttagtatatttttatgcatttttcagagtcagcagtttcaaatcttatngttatcangttanaaaattttagcccacatntcaggctccgtaaatcatttgagccattattttttcccaacaaatggggaattttttcttaaaa

SEQ ID NO: 49335 - DNA, 310 bp, Homo sapiens
tatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttt

SEQ ID NO: 49336 - DNA, 300 bp, Homo sapiens
  misc_feature 30, 280, 295: n = A,T,C or G
gcagttctagcttcactttcacgatgtttnccttggtcaaaagcgcactaaatcgtctccaagttcgaagcattcagcaaacaatggcaaggcaggagccaccagaaacgtacacctgattttcatgacaaatacggtaatgctgtattagctagtggagccactttctgtattgttacatggacatatgtagcaacacaagtcggaatagaatggaacctgcccctgttggcagagttaccccaaaggaatggaggaatcagtaatcatcccagctggngtaataatgaattgnttaaa

SEQ ID NO: 49337 - DNA, 332 bp, Homo sapiens
ggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacag

SEQ ID NO: 49338 - DNA, 300 bp, Homo sapiens
tgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggcacagtcaagaaaggcaaaccagagctcaagaaaaaaggtcatccagcagtggtcattcgacaacgaaagcataccgtagaaaagatggcgtgtttctttattttgaagataatgcaggagcataagtgacaa

SEQ ID NO: 49339 - DNA, 300 bp, Homo sapiens
  misc_feature 31, 104, 280: n = A,T,C or G
aaggcaactttcttgcttttgaaatcatgtnggggtaagaggtaaggaatccagctacaattttattagtgcttgaaacgggcttccttgaattctccaggccntatcatttttttttcttactaatcagaagagagctggggtagaagccccatgtttgtattccatgaaacacgtcgggttggagtaaaggcaaaaacagctagacacaccaggtgggctgtttgacatttataagctgcactcatcaacactcctgtttctcctttctctgggacgngtggattaaggggtgtgaag

SEQ ID NO: 49340 - DNA, 300 bp, Homo sapiens
tatcgacgcagcgtccccacttggatgaagttgacatctgacgacgtgaaggagcagatttacaaactggccaagaagggccttactccttcacagatcggtgtaatcctgagagatccacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgctgattctaa

SEQ ID NO: 49341 - DNA, 375 bp, Homo sapiens
gaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgagg

SEQ ID NO: 49342 - DNA, 157 bp, Homo sapiens
ggaaaggagaatgttttgtggaccactttggttttcttttttgcgtgtggcagttttaagttattaagtttttaaaatcagtactttttaatggaaacaacttgaccaaaaatttgtcacagaattttgagacccattaaaaaagttaaatgagcaa

SEQ ID NO: 49343 - DNA, 370 bp, Homo sapiens
tactgcttgttagggtttgaatcccagctttaccacctagtagctgtatgaccttgggtatattacctaatatctatatgcttcagtttttctgatctgtgaaattaggataataatagtacctaagttatttagttgctgtgaagattgaatgaattaaggcctgttaagtgctagaggacttcctggtcttagcaatcatttaatgattgtcagatattattattgtgattattatcattttattgcattctagagtaggagagaagaaatgaacacataatcaaatagatggctataatgcaagtagtgataaatgctatgaagaaaaatatcagcataaggggatatagaatgacagagatgaaag

SEQ ID NO: 49344 - DNA, 300 bp, Homo sapiens
  misc_feature 205, 228, 283: n = A,T,C or G
cctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgccaaaacaaagaaacatgtcagcagggcctatggtggntccatgtgtgctaaatgtgtcgngacaggatcaagcgtgctttccttatcgaggagcagaaaatcgttgggaaagtgntgaaaggcacaagcaca

SEQ ID NO: 49345 - DNA, 336 bp, Homo sapiens
atgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattct

SEQ ID NO: 49346 - DNA, 300 bp, Homo sapiens
gtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcccggggaaccccaagagtgatgagatgaatgtgaaggtgctggactttgagcactttctgcccatgctgcagacaggtgccaagaacaaggaccagggcacctatgaggattatgtcgaaggacttcgggtgtttgacaaggaaggaaatg

SEQ ID NO: 49347 - DNA, 169 bp, Homo sapiens
ttgaactcctgagctcgtgatccgcccgcctcggcctcccaaagtgctgggattacaggcgtgagccaccgcgcccggctaaaaagtatgttctcatacattatttcatttgatgcttactgcctcttcggcatatggtactatccataattggcaaatatgagccctg

SEQ ID NO: 49348 - DNA, 349 bp, Homo sapiens
acagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgcacatctgagttcaaaaaaattactttgaataccttaatatttgctgcatttttttccgtatatataacatgtcttctttcagaatgggaatatatgtgtgcctcccaacatttactgt

SEQ ID NO: 49349 - DNA, 300 bp, Homo sapiens
  misc_feature 286: n = A,T,C or G
ccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtggcacatgttatggcagattgaaaaggatctcattccatgggaaaaaaaaaaatcctgtcttgncataaatggcaatg

SEQ ID NO: 49350 - DNA, 294 bp, Homo sapiens
accctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccg

SEQ ID NO: 49351 - DNA, 320 bp, Homo sapiens
tgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttg

SEQ ID NO: 49352 - DNA, 125 bp, Homo sapiens
  misc_feature 73: n = A,T,C or G
attttggaaactacattttaaactttggaatcaaattgtttcttatttgggaggataatgtatatacattggnattatgttaaataataaaattgttctaatttggtgccaaaaaaaaaaaaaaa

SEQ ID NO: 49353 - DNA, 326 bp, Homo sapiens
cagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacgttacaggtctttgtgggaagaaacagaaagaaatcacaaaagcaattaagagagctcaaataatggggtttatgccagttacatacaaggatcctgcatatctcaaggacc

SEQ ID NO: 49354 - DNA, 377 bp, Homo sapiens
tcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaaggtaaatggcacagatcctgaagatgtcatcagaaatgcctttgcttgctttgatgaagaagca

SEQ ID NO: 49355 - DNA, 238 bp, Homo sapiens
ggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcag

SEQ ID NO: 49356 - DNA, 213 bp, Homo sapiens
cagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataaggg

SEQ ID NO: 49357 - DNA, 336 bp, Homo sapiens
taaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgctttataagcatatttgtaaactcagaactgagcagaagtgactttactttctcaagtttgatactgagttgactgttcccttatccctcacccttccccttccctttcctaaggcaatagtgcacaactta

SEQ ID NO: 49358 - DNA, 317 bp, Homo sapiens
acagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaaga

SEQ ID NO: 49359 - DNA, 257 bp, Homo sapiens
aagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtgctgaaatcactccaaaaggcagagccctg

SEQ ID NO: 49360 - DNA, 295 bp, Homo sapiens
ccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaa

SEQ ID NO: 49361 - DNA, 364 bp, Homo sapiens
tgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcca

SEQ ID NO: 49362 - DNA, 366 bp, Homo sapiens
ctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtg

SEQ ID NO: 49363 - DNA, 118 bp, Homo sapiens
ggcaggttccttaacctctctgcccctcaatttcctctgctatacgatcaggttgctggccgggtgcagtggcttacaactgtaatcctagcaatatggcaagaccccatctctacca

SEQ ID NO: 49364 - DNA, 300 bp, Homo sapiens
  misc_feature 31: n = A,T,C or G
accatggctcccgaagttttgccaaaacctnggatgcgtggccttctggccaggcgtctgcgaaatcatatggctgtagcattcgtgctatccctgggggttgcagctttgtataagtttcgtgtagctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgcactgacttgtgtcctgaacta

SEQ ID NO: 49365 - DNA, 302 bp, Homo sapiens
aaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtag

SEQ ID NO: 49366 - DNA, 381 bp, Homo sapiens
tacatctctctttctggcctaggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaat

SEQ ID NO: 49367 - DNA, 234 bp, Homo sapiens
aaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccagttacagactttgtttcttctccagtcctgctgcttcacttgactagccttttaaaaaaaaaaaaa

SEQ ID NO: 49368 - DNA, 277 bp, Homo sapiens
aatctgcataagcatattgagttgtgacaaactatgtagccaactggaaaagttgagatgtggagtgctctgattgtttgacttctgaactcccacagtgcatacaagtgtattggttaatctctctactatatgttttgaatttggatgctttactaagcattgatggtagatactgaacttatttaagcacagtgatagtatttgaaagaaatataaaaatttagtggtattggtgctctgtcttttccttttttctgagtaatctcttgggaag

SEQ ID NO: 49369 - DNA, 275 bp, Homo sapiens
tttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctag

SEQ ID NO: 49370 - DNA, 385 bp, Homo sapiens
acaatgatgtgcagacatactttataacaaaaatacactgcgtgtataccgtgtaacaataagttgggctcatttctagtctgttaggacactggtaaattatcaggatatctgacacaaaattctgttatcctgtatatgtgacagccatgtgacaattaaatatttctggttccctaccaagtgcataactgggacctggattttggttaaaatttatgcagttctcatgatctgagaattggaaagaattttagagatattcttgtcagccaaagattttggatattttgttacatgtcctcctattctcatggagataaaaatgcagtgttgagggggatccagacaaccttatgtgtttaaaatggtggattgtttccta

SEQ ID NO: 49371 - DNA, 300 bp, Homo sapiens
aaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggccttgctggaaacaaaggcttagcaaacaatttttgttcaatgcccaccgagacatatagaattgggaactgatacatgtgtcccttatagctcaaaaat

SEQ ID NO: 49372 - DNA, 295 bp, Homo sapiens
tgaacgcctcgagtattcccggatgattttgattaatttcctcattccttttctcctgagtccagatatccccagcatagattgcttcccacatagtatctccaattttaagtaatatatagtctaatatctgtttctttattggctaagtgtctttctctgcgtctcctctatatcatcaatagtcctctgtcatctttctgcacatcttgggatgccgtcctcaaagaatcacagagtatgttttcctttaacacaatttatgaccacctagcattttcaagataccataccg

SEQ ID NO: 49373 - DNA, 143 bp, Homo sapiens
aggatctgcctacaaactgggttgctactttaccaactggtcccaggaccggcaggaaccaggaaaattcacccctgagaatattgaccccttcctatgctctcatctcatctattcattcgccagcatcgaaaacaacaagg

SEQ ID NO: 49374 - DNA, 343 bp, Homo sapiens
tcacagtgcaccatgtcacttgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaa

SEQ ID NO: 49375 - DNA, 300 bp, Homo sapiens
  misc_feature 152, 167, 226, 263: n = A,T,C or G
gtttataacagatgatgatgtgcctgcagatatggttgcagaagaatcaggtcctggtgcacaaaatagtccataccaacttcgtagaaaaactcttttgccgaaaagaacagcgtgcccacaaagaacagtatggaggtaactttaactgnaggtgcttttctttntgtaatgaaagaatttcaagaacaaaaaagggaatggcatcctttttagaagtaatgantatggatgataagaatatttgctttactaggttctgnttggttttggaaggcgcctcaacttcaactacagaaa

SEQ ID NO: 49376 - DNA, 360 bp, Homo sapiens
gaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgag

SEQ ID NO: 49377 - DNA, 140 bp, Homo sapiens
  misc_feature 24: n = A,T,C or G
tggaaaacatatgaaatataaatnatctgaatattagatgctctgagaaattgaatgtaccttatttaaaagattttatggttttataactatataaatgacattattaaagttttcaaattattttttaaaaaaaaaaa

SEQ ID NO: 49378 - DNA, 304 bp, Homo sapiens
tgatcgtttctctgagatgatgaacaacatgggtggtgatgaggatgtagatttaccagaagtagatggagcagatgatgattcacaagacagtgatgatgaaaaaatgccagatctggagtaaggaatattgcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattg

SEQ ID NO: 49379 - DNA, 300 bp, Homo sapiens
  misc_feature 19, 44, 52, 87, 101, 137: n = A,T,C or G
tctttgaaagatagagatnaatacaactacttaaaaaatatagncaataggntactaagatattgcttagcgttaagtttttaacgnaattttaatagctnaagattttaagagaaaatatgaagacttagaagagnagcgaagaaaagaatagagaagatagggaaattagaagataaaaacatacttttagaagaaaaaagataaatttaaacctgaaaaggaggaagcagaagaaaaaagacaagctagggaaacaaaaagctaagggcaaaatggacaaacttagaagaaaattgg

SEQ ID NO: 49380 - DNA, 344 bp, Homo sapiens
ttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctggctacaatattcaaaaggagtctactcttcatcttgtgttgagacttcgtggtggtgctaagaaaaggaagaagaagtcttacaccactcccaagaagaataagcacaagagaaagaaggttaagctgctg

SEQ ID NO: 49381 - DNA, 124 bp, Homo sapiens
  misc_feature 41, 74, 81: n = A,T,C or G
ataaaaacaaatcttgatatccagaagcacatgaaggttgnaactttccaccctgccattttgggaaaactgcngcatctnggccttttaaaacacaaattttaaactcaaccaagctgggaaa

SEQ ID NO: 49382 - DNA, 232 bp, Homo sapiens
accattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcca

SEQ ID NO: 49383 - DNA, 166 bp, Homo sapiens
aagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaaaaaaaaaaaaaa

SEQ ID NO: 49384 - DNA, 224 bp, Homo sapiens
aaataagctgctatccttcctgttatattcatactgcatgttatgagcaaaaggggagagaagtcgccaactttttggagaaaaagaataaaatcccagactttatttttgggatcatctgaggtgggaagatggcttgggcccaggagtttgagaccagcctgggcaacatgaagagaccccctgtctcttccaaaaaaaaaaaaaaaaaaaaaaaaaaaaaa

SEQ ID NO: 49385 - DNA, 195 bp, Homo sapiens
tattatactactttctcggtattttgtgtgcatgcctcatttccctgacttaaacctcactgagagcgcaaaatgcagctttatactttttactttcaattgcctagcacaatagtgagtacatttgaattgaatatataataaatattgcaaaataaaatccatcaaaaaaaaaaaaaaaaaaaaaaaaaaaaa

SEQ ID NO: 49386 - DNA, 299 bp, Homo sapiens
tccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgtctggccgcaatactgtaggaacaagcatgatcttg

SEQ ID NO: 49387 - DNA, 159 bp, Homo sapiens
ggagaagatagaagtttgaagtggaaaactggaagacagaagtacgggaaggcgaagaaaagaatagagaagatagggaaattagaagataaaaacatacttttagaagaaaaaagataaatttaaacctaaaaaaaaaaaaaaaaaaaaaaaaaaaaa

SEQ ID NO: 49388 - DNA, 314 bp, Homo sapiens
ccacaatctctctactttttctcattctctggttcctgatggtgatctgggttctacctgaagggagcccaggattagagaaaggaagaatattacaggcaaactggtctctttccaacatggcccaatccctcttggcggaatctgcttcagggaagttaagcgtttgtctagaaattatgatgtcatgttacggagcccttattccctcctctataaaacaactttcctgttgtcaattcttctgtaactatgttatctactatgctgaccacagggtacatgtggctttccacattaataaaaaaaaaaaa

SEQ ID NO: 49389 - DNA, 128 bp, Homo sapiens
catagacaatctcaaaaacctcacctgtgaaattattagtatataccagctggccacctaatgtcaaaacagccaatgaaattttctcagttgagtcaaaccaatggctattcagaaaaaaaaaaaaa

SEQ ID NO: 49390 - DNA, 288 bp, Homo sapiens
aaatgaaggtacagatggattgaaacataaaattgtagcctttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttgg

SEQ ID NO: 49391 - DNA, 300 bp, Homo sapiens
  misc_feature 25, 134, 140: n = A,T,C or G
agagagatttttctaagatatgtgnaacacaccaacgtactgtgacctaggaaaggctgctaaggatgtcttcaacaaaggatatggctttggcatggcaagatagacctgaaaaccaagtcttgaagtggagnggaatnttctacttctggcatgcttacactgatacagggaaagcatcaggcaacctagaaaccaaatataagggtctgaactatggacttaccttcacccagaaatggacacagacaatactctagggacagaaatctctgggagaataaaggtggctggaagggt

SEQ ID NO: 49392 - DNA, 341 bp, Homo sapiens
gccgaggaacaagtcggcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgcttgataagaggcgcaaaagaaaagagtctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaggcagat

SEQ ID NO: 49393 - DNA, 187 bp, Homo sapiens
  misc_feature 29, 30: n = A,T,C or G
ctactaaaaatacaaaaattgccctagcnnggtagtacacacctgtaaacccagctacttaggaggctcaagtgggaggatcgcttaaactcaggaggcagaggttgcagtgagccgggatcacgtcactgcactccagcctggatgacagagcaagactctgtctcaaaaacaacacgtttaaaaa

SEQ ID NO: 49394 - DNA, 283 bp, Homo sapiens
agaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttctttaaactgaggattgccattaaacacagttgttttctaaaaaaaaaaaaaaaaaaaaaaaaaaaaaaaaaaaaaaaaaaaaaa

SEQ ID NO: 49395 - DNA, 300 bp, Homo sapiens
  misc_feature 27, 233: n = A,T,C or G
ttgcaaatgtagtatggcctgtgcacncagcagtgggacagcaacctgtagagtggccagcgagggcgtgctagcttgatgttggatctcaagagccctgtcaagtagagtagaagtctcttccagtttgctttgccttctttctaccctgctggggaaagtacaacctgaatacccttttctgaccaaagagaagcaaaatctaccagggtcaaaatagtgccactaacggntgagttttgactgcttggaactggaatcctttcagcaagacttctcttgcctcaaataaaaaggctt

SEQ ID NO: 49396 - DNA, 317 bp, Homo sapiens
tcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtatccttaacctgtctatattacttatacctattggctatatagctttaatttataggtggcaggttaactattggcatgctggca

SEQ ID NO: 49397 - DNA, 300 bp, Homo sapiens
  misc_feature 154, 156, 188, 201, 217: n = A,T,C or G
atatcacagcataaccccaccctttacattttgtgcagtgattattttttaaagtcttctttcatgtaagtagcatacagggctttattatcttttcatctcattaattcaattaaaaccattaccttaaaatttttttctttcgaagtgtggngncttttatatttgaattagtaactgtatgaagncatagataatagnacatgcaccttaaggnaggaggaaagaattacaatttctttaaatcatttatctggattttaatggttaattagcattttcaagaagacggattatcta

SEQ ID NO: 49398 - DNA, 366 bp, Homo sapiens
agaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattt

SEQ ID NO: 49399 - DNA, 317 bp, Homo sapiens
ctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagaa

SEQ ID NO: 49400 - DNA, 201 bp, Homo sapiens
tgatttattgcaatgttcagtcctagtttttacttttattcttaaagcattcagttttgctctcaattttatgtaccttagttctgagttagacctgcagatgtgtacagatagttcatatttatgtattgcacataatcatgctattcagcattgatgctatattgtattatgtaaataataaaagccatgtacagaggg

SEQ ID NO: 49401 - DNA, 431 bp, Homo sapiens
agcccatttccactatgttctatcaatgggagcagtgtttgctatcatagcaggatttgttcactgattcccattattttcaggcttcaccctagatgacacatgagcaaaagcccacttcgccatcatattcgtaggagtaaacataacattcttccctcaacatttcctgggcctttcaggaataccacgacgctactcagactacccagatgcttacaccacatgaaacactgtctcttctataggatcattttcactaacagctgttctcatcatgatctttataatttgagaggcctttgcttcaaaacgagaagtaatatcagtatcgtatgcttcaacaaatttagaatgacttcatggctgccctccaccatatcacacattcgaggaaccaacctatgtaaaaaaaaaaaaaaaaaaaaaaa

SEQ ID NO: 49402 - DNA, 229 bp, Homo sapiens
gcctgtggacctttaatcacaacgaaagagggtagagtgtggagctgagccttgtgcctctggacacattacagcctgggcctctaccaggacccagcaccgaattatgatcagtaattctgtattattttcctgaaggagacactcttgcaaattgtgtaagcttcagggcccctcaaaacctggagaatcttctgacccctttccataccaaaaaaaaaaaaaaaaa

SEQ ID NO: 49403 - DNA, 372 bp, Homo sapiens
gaggcagccagcgcaggggcttctgctgagggggcaggctggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaatccaatagaagggcaatgcttttagattaaaatgaagg

SEQ ID NO: 49404 - DNA, 270 bp, Homo sapiens
taagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaaggtgtttaactagactgcgtgt

SEQ ID NO: 49405 - DNA, 169 bp, Homo sapiens
tttaaaatcacttgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatgg

SEQ ID NO: 49406 - DNA, 224 bp, Homo sapiens
tgccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacccaaaaaaaaaaaaaaaaaaa

SEQ ID NO: 49407 - DNA, 258 bp, Homo sapiens
aaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtcttgaaaaaaaaaa

SEQ ID NO: 49408 - DNA, 244 bp, Homo sapiens
gattattctgcagagagggaactgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaaaaaaaaaaaaaaaaaaaaaa

SEQ ID NO: 49409 - DNA, 404 bp, Homo sapiens
aaaaggagaatgagaaggcatctttctagtgtaggtgagcacttaggttctctaacagaggccagatatgtacagttaaaatgaagtggaaagtcattcaattgcttagaaactttagaaagactggaagacaaatatggacaaagtaatgcttttaaaaatccaatttttacccgacttattcaggctttgttttattttagaacagcagcattagcttggggtgaacatcttaatggggacaaaaatgcattacagttagagcagcttttgtcagaaatactgcatggtgacaacaagaacctttagaatggccctattacattcactgtgccattctaaaataaaaactctctgtttaatatagagtcataatgtgtttacttaggaaaatactgacagcc

SEQ ID NO: 49410 - DNA, 214 bp, Homo sapiens
accgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataaaaaaaaaaaaaaaaaaaa

SEQ ID NO: 49411 - DNA, 261 bp, Homo sapiens
ggccaaggagatggacgaggaagataaggctttcaagcagaaacaaaaagaggagcagaagaaactcgaggagctaaaagcgaaggccgcggggaaggggcccttgccacaggtggaattaagaaatctggcaaaaagtaagctgttccttgtgcctgaggagatggtgaccctttttttcatctgtatttaaacctctctattccctgccataacatcttttgccacgtatagctggaattaagtgttgtcttggagctg

SEQ ID NO: 49412 - DNA, 226 bp, Homo sapiens
aaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttttt

SEQ ID NO: 49413 - DNA, 226 bp, Homo sapiens
ctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttgg

SEQ ID NO: 49414 - DNA, 266 bp, Homo sapiens
atgccagtgtggtacgtgagatctagctccaagtacatctatgaccagtgcccagcagtggctggatatggccccattgagcagctcccagactacaaccggatccgtagcggcatgttctggctgcgcttctaggcgggaagcctatgtaagcaagagggcagggcggggtttgtggtcccccccccaccacaaacacagcacttcggctcctctaacctgtgccacaggtgaccaccaataaaatcctctgctgagaaacaaaa

SEQ ID NO: 49415 - DNA, 299 bp, Homo sapiens
  misc_feature 266, 291: n = A,T,C or G
aactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgnataattgttcattagaaaggacagntttacatg

SEQ ID NO: 49416 - DNA, 445 bp, Homo sapiens
cttcaaaaaaactataagcatcgtcaaacctctggtgaaactgaccaagaagaaagggagttgtcacaagtaacattaggaatgaaaaaaacaggcataactttatggcaaaacatttgaaagcagaaaagggaaaattcctttaaaaactataactcactaaatttattaaagaagaaatagatatctggagagtgccataaccattaattaattgaatgggccatttaagatcttcccacaaagaaagtcccaagcccggatgattttacaggttagttccaccaaacactcaaagaacagataattcgaatcttctgcaaactcttccagggagctagcaggagagtggacacttgttctgtgaggccagtactgccatccccaaaccaggcaaggttaatacaataaaataaaaactgcagaccaatctcactcatgcaca

SEQ ID NO: 49417 - DNA, 203 bp, Homo sapiens
ggaggtgtgtgggagcaaaggtgtaatggtctaaggaaatgacagtgaagcaaaagcaacaattgtaacaatgtgtattacaacaatcgcaccaaaagggagaaaagtgaatacagctctataggcataatatctccatctcactggaattacgcacaaacctgaagtaggttctgattatttgtggtaaactccagagcaac

SEQ ID NO: 49418 - DNA, 300 bp, Homo sapiens
  misc_feature 192: n = A,T,C or G
gagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggcagaacaccgtgggctgntacttgctttgagttggaagcggttgcatttacgcctgtaaatgtattcattcttaatttatgaaggttttttttgacgcaattctcgatctttgaagagatgacaac

SEQ ID NO: 49419 - DNA, 300 bp, Homo sapiens
  misc_feature 30, 31: n = A,T,C or G
cctgatgctacagacgaggacatcacctcnnacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagctaatgatgagagcaatgagcattccgatgtgattgatagcaggaactttccaaagtcagccggggaattccacagccatgaatttcacagccat

SEQ ID NO: 49420 - DNA, 300 bp, Homo sapiens
gcaacatttcaagtgcttgagagccatgcatgattagtggttaccctattgaataggtcagaagtagaatcttttcatcatcacagaaagttctattggacagcgctcttctagatcatcataagactacagagcacttttcaaagctcatgcatgttcatcatgttagtgtcgtattttgagctggggttttgagactccccttagagatagagaaacagacccaagaaatgtgctcaattgcaatgggcacatacctagatctccagatgtcatttcccctctcttattttaagttat

SEQ ID NO: 49421 - DNA, 353 bp, Homo sapiens
gaaggatgaatcccctttttaaaaagttgttgttgttgttgtttatttgattttgagttaggagggataatagagaagtccatttaaaaattatttttagaagctaaagaaagtaattatgcttcctgtgaattgcttttactggcatctttgttttcctctttgatgttagtaaatttggggaatacgtggggctccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacag

SEQ ID NO: 49422 - DNA, 300 bp, Homo sapiens
cggagctttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatg

SEQ ID NO: 49423 - DNA, 300 bp, Homo sapiens
  misc_feature 258, 261, 276, 284: n = A,T,C or G
cgctctcgccgaggaacaagtcggtcaggaagcccgcgcgcaacagccatggcttttaaggataccggaaaaacacccgtggagccggaggtggcaattcaccgaactcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgnggngaaggtctaagacgngggatcgnttccagatgagaattc

SEQ ID NO: 49424 - DNA, 449 bp, Homo sapiens
aacaaactccaaagaattgaagaggagagaaaacttccaagctcattttatgaggccagcgttaataccaaagccagacaaaaatactacaaggaaaaaaaaacagatcaagctccctgataaatattgattaaaaaaattctcaagaaagtacaaggaaacttaattcaacagcattttaaaaggattccacgccatgaccaagtgggatctatccctggaatgtaaggacgtttcaacatacaagaatcagttaatataatacactacattaaaagaatgaaggttaaaaactacatgatcatttcaattgatgcagaaaaagtatttggcaaaattcatcatcctttcatgataaaaacactcaacaaactaggaatagaactaaactaccctaacccaataaatgccatttatgaagagacaataactaataactaatatcacac

SEQ ID NO: 49425 - DNA, 300 bp, Homo sapiens
  misc_feature 261: n = A,T,C or G
atcttgctgtactatagagctcagaaggacacagcccgtcctcccctgcctgcctgattccatggctgttgtgctgattccaatgctttcacgttggtcctggcgtgggaactgctctcctttgcagccccatttcccaagctctgttcaagttaaacttatgtaagctttccgtggcatgcgggcgcgcacccacgtccccgctgcgtaagactctgtatttggatgccaatccacaggcctgaagaaactgcttggtgngtatcagtaatcattagggcaatgatgacattctgaaaa

SEQ ID NO: 49426 - DNA, 152 bp, Homo sapiens
tttagggaaagatacgcgatggtaaaactcatgagcaggattggaaaatgtacaatatgtataaattaataaaatgttgtattattttgaaaataatgatggaattcatgcgagggagtgacaaaaagacttgagacaggatggttattctt

SEQ ID NO: 49427 - DNA, 300 bp, Homo sapiens
  misc_feature 30, 57: n = A,T,C or G
cttgtataacttagggagcgaagaaaatgnaggcgcgaaagtgaaaagtgaggcagntagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactc

SEQ ID NO: 49428 - DNA, 322 bp, Homo sapiens
ttgtccaaagacaattaaaatgcttctttcataaaattagatatttttccaaagggttgagaaagaactagagagcccggctttgtaccgttctcctcttcaaaacgcggtgttgctgtcatttcactcctgatcccaaatcagctttctgaaaatacagtcaaatcatgctgggctgcctaaatatatttgcagtgaagtagtgaataatttgaagtgactagtattccacaaatgttttctttatatgaaattttctgttaaattaaatagaatctctttatatcaagaaaatcaaataacccctacctctaaattgagt

SEQ ID NO: 49429 - DNA, 300 bp, Homo sapiens
  misc_feature 248, 268: n = A,T,C or G
cacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtaagatattgcaccctatgacattggnggcctgatcaagaatttggngtggcgttggcctgtttgctttttataaacca

SEQ ID NO: 49430 - DNA, 154 bp, Homo sapiens
gatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcaa

SEQ ID NO: 49431 - DNA, 238 bp, Homo sapiens
acaggctggactcagctacatccgatactcccagatctgtgcaaaagcagtgagagatgcactgaagacagaattcaaagcaaatgctgagaagacttctggcagcaacggtaaaaattgtgaaagtaaagaaggaataatctaccctgactaaagcttgaaatgctacatttccaaggtgaagatgtgtgggcacatgttatggcagattgaaaaggatctcattccaaaaaaaaaa

SEQ ID NO: 49432 - DNA, 152 bp, Homo sapiens
tgttttctctttgaaagatagagattaatacaactacttaaaaaatatagcaataggttactaagatattgcttagcgttaagtttttaacgtaattttaatagcttaagattttaagagaaaatatgaagacttagaagagtagcatgagg

SEQ ID NO: 49433 - DNA, 411 bp, Homo sapiens
agcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatgctaaatagcaaaatttatatttagaagcaaaaaaaaagcatagagatg

SEQ ID NO: 49434 - DNA, 300 bp, Homo sapiens
  misc_feature 211, 267: n = A,T,C or G
accttctctccatgctgccattatgccaaaacaaaagctgtgataaaaaaagtgcttgagagagtgtgttgataagaaagtgatttatttacagatggaagtctttgtttcatgaagctaccaaactttaaaaagaatgtcacccttttttttgtttgttatggaaaccagagattgtaaaatggaaaaagaatcgttttttttgttgctntttgatgctgcacgaggtttttgccacttttttcatatatctgggataaaaaaatngtggttactatggaattagtattacatttggag

SEQ ID NO: 49435 - DNA, 299 bp, Homo sapiens
  misc_feature 12, 14, 15, 48, 226: n = A,T,C or G
acacttaggttngnngaaagcattttcgacatttgtataaaagaattngtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgntaagctattaggattttctaatagaacttactccccctgctcccagcttatggttcttttaatgacttctgga

SEQ ID NO: 49436 - DNA, 300 bp, Homo sapiens
  misc_feature 6, 10, 19, 24, 25, 38, 43, 48, 70, 72, 74, 101, 103, 134,135, 282: n = A,T,C or G
agcggngggnggggggtgnaatannccaatggaagacnccggnataantggggaaaaggcccgagaggtngngnaaagtgtgttagagcagcctcttttcntngtcaagtaggccttgggtacaaggatatgannaaataagctttaaaaatttatttggatatatagtttctatattctaagtgtacatatgggtttatagacatatatatattcacacatatatgaatatgtatacatatattttttaagctcttatctaaagtggtttttaagtgatgngaagtttaacctcagcat

SEQ ID NO: 49437 - DNA, 300 bp, Homo sapiens
  misc_feature 50, 57, 65, 66, 77, 113, 133, 140, 234, 248, 260, 295: n = A,T,C or G
ccaagaaactgatgttatttgatttatttaaaggctaaaatttgaggttntattctntgcacaanngtttcattggntgacacttaatgcactcgtcatttgcatacgacagnagcattctgaccacacttgnacgctgnaacctcatctacttctgatggttttaaaaaatgacttttaacaaggagagggaaaagaaacccactaaattttgctttgttccttgaagaatgnggcaacactggttngggaatttattngggcaggcatgcacacaggtttgataaagggcagnaacaa

SEQ ID NO: 49438 - DNA, 288 bp, Homo sapiens
ggccattttctgaaaacccctgttaggaaggttggatttggcgtgacttgcttgagcaagagtcctggggagagattttgaggtttaatttaacggtatatccagagctaacagtgactcaactcgctagttctgcaagtcagatgtacacttagagtctctctgtgaagggtttgggtctgagctgtgtagtatgtcaaactgccagtaagccagcccctcaccctctgatagatattcctttaatgcaccagacttcatgtttgataaatgaataatgggtgaaat

SEQ ID NO: 49439 - DNA, 244 bp, Homo sapiens
gggtgagccagtggaacagcgggagacctgtgctagttttacagattgcctccttatgacgcggctcaaaaggaaaccaagtggtcaggagttgtttctgacccactgatctctactaccacaaggagaatagtttaggagaaaccagcttttactgtttttgaaaaattacagcttcaccctgtcaagttaacaaggaatgcctgtgccaataaaaggtttctccaactggaaaaaaaaaaaa

SEQ ID NO: 49440 - DNA, 300 bp, Homo sapiens
gggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagtttttg

SEQ ID NO: 49441 - DNA, 300 bp, Homo sapiens
  misc_feature 101, 247: n = A,T,C or G
taactctgtagctggaacacaagaagtgtttgtttaatgaatgacgtacacatttaagatctgtttggacgcggaggataatcctgtgaattgctaatagntcactgggtttggcccttagtgttgcttcagtatgctgagacggaaaccaacacgcctagagctaaagcttgatgacattgaagagttgagaacattcgaaaggacctggagacccgtaagaaacagaaggaagatgtggaagtgnaggaggcagtgatggagaaggagccattgggcttagcagtgatcccaagaacc

SEQ ID NO: 49442 - DNA, 300 bp, Homo sapiens
  misc_feature 299: n = A,T,C or G
aaaaagaaaagtgtaatgcaagaatttaaagaaatatttttaaagccacaattattttaatattggatatcaactgcttgtaaaggtgctcctcttttttcttgtcattgctggcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaaggggattctcctccttcatcctgna

SEQ ID NO: 49443 - DNA, 267 bp, Homo sapiens
gaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgcaataaggatgtcttcagagatcctgctcttaaacgcaaggcccgacgggaggccaag

SEQ ID NO: 49444 - DNA, 138 bp, Homo sapiens
gaccaagatgaagatgcagaggaccattgtcatccgccgagactatctgcactacatccgcaagtacaaccgcttcgagaagcgccacaagaacatgtctgtacacctgtccccctgcttcagggacgtccagatcgg

SEQ ID NO: 49445 - DNA, 300 bp, Homo sapiens
  misc_feature 152, 198, 207, 219, 260, 274, 278: n = A,T,C or G
taaacacaaaattatcagtgttttagaaacatgagtccggactgtgtaagtaaaagtacaaacattatttccaccataaagtatgtattgaaaccaagttgctctgtgtacagaatacatacttattcccatttttaagcatttgcttctgntttccctacctagaatggcaagatggttttcaggtatctccccatntggcaaagntgacctcaaganaacatttttcattaaagcatctgagatctaagaacacaatnattattctaacaangatnattaagctcattcacttatttg

SEQ ID NO: 49446 - DNA, 300 bp, Homo sapiens
  misc_feature 30, 291: n = A,T,C or G
aaaaaggaaaatgaacttgaagtaggtctngagaataggcagaaggaggaggagggaaattatttgataagaggagaagctaaacatgggaaatttctaggcctgttttaagtcaggcaagatcagtttgacagaagcaggtgatttggaaaggtgaataatctgaaaagtttaggttaaaatcagatttttgaaggccctgaataccagaattgtgatggaaaatgccattctggtaaaggttataagcaaaggatggatgtgatataagcacatcttaaatatgatggngatccacat

SEQ ID NO: 49447 - DNA, 300 bp, Homo sapiens
  misc_feature 290: n = A,T,C or G
atttggaggactaactggacaaatagtggttgcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcaagaattcaatattcacctgccagactggcttatcaagacaaaggngccttcataa

SEQ ID NO: 49448 - DNA, 134 bp, Homo sapiens
  misc_feature 84, 97, 103, 107, 119: n = A,T,C or G
aaagaaaagatgaaaggcaggcctatttcatcacaagaacacacacatatacaccgaatagacatcaaactcaatgctttattnggaaatttagggntttttnatcnctactggcaaangatgggcaaaacctt

SEQ ID NO: 49449 - DNA, 249 bp, Homo sapiens
ctgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcg

SEQ ID NO: 49450 - DNA, 300 bp, Homo sapiens
  misc_feature 245, 260, 282, 296: n = A,T,C or G
gggcgcggacagtcgagatgtcagagaaaaggcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgactagagaacatgggtataagatggagacttcatagcatccagaagaaggggngaagaacctaaactngcctgttaatacattctagggnaggagacccagganggga

SEQ ID NO: 49451 - DNA, 185 bp, Homo sapiens
atacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgattagtggacaacagaacaatattggaatgg

SEQ ID NO: 49452 - DNA, 300 bp, Homo sapiens
cagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactgggggaatggagcaaaacagtctttgaatatcgaacacgcaaggc

SEQ ID NO: 49453 - DNA, 279 bp, Homo sapiens
caacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaaaaaaaaaaaaaaa

SEQ ID NO: 49454 - DNA, 393 bp, Homo sapiens
aatcatgatatgtaaactacttatatatttactaagaagactaaaagacaaaactatttaaaataactacaatttgttaagagataggcaatataaaatgcaaattgtgacatcaaaaattcaaaatgggggaagagagttaatgtgtacaggttttttctttgtttctttcctttttgtatgatcagagataagttgggatctatttaaaataacttgttatatctataagatgttttctgtaagccacacaggggaaaaactgaaatcctttccactaagatatggaataagacaaggatgcccactttcaccatttttattcaatatagtactggaaattatagccagaggaattaggcaagagaaagaaatacagggcatccaaattag

SEQ ID NO: 49455 - DNA, 208 bp, Homo sapiens
aagcaaatatagtgtatatacacaacggaatatcattcagccataaaaaagttaatgaaatcctgtcatttgcagcaacatggataggactggaggtcattataagtgaaataagccagtcacagaaggacaaataatggatgttttgaatcataggtaggggcaaataaaagtagaaaaatgaaaaaaaaaaaagacccctaccttt

SEQ ID NO: 49456 - DNA, 300 bp, Homo sapiens
ggtttgatcctgactgctgtcatggcgtgccctctggagaaggccctggatgtgatggtgtccaccttccacaagtactcgggcaaagagggtgacaagttcaagctcaacaagtcagaactaaaggagttgctgacccgggagctgcccagcttcttggggaaaaggacagatgaagctgctttccagaagctgatgagcaacttggacagcaacagggacaacgaggtggacttccaagagtactgtgcttcctgtcctgcatcgcatgatgtgtaacgaattctttgaaggcttccc

SEQ ID NO: 49457 - DNA, 211 bp, Homo sapiens
tactgtatccagctatctttcttggatccttttgttcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaaaaaaaaaaaaaaaa

SEQ ID NO: 49458 - DNA, 312 bp, Homo sapiens
tagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagttttg

SEQ ID NO: 49459 - DNA, 233 bp, Homo sapiens
  misc_feature 31: n = A,T,C or G
caccgtgaatctagtcttgactgcccctggnggaacatttgaaagcccttgggactccaggagaggtgtttttgcagcatgtatgctaaatttgtgagttagcaagaccctgctgtgattactatgttgtacagatcttcaaagtatattgcctaatatgagtcatgctatttctagattgaatttaaagtaagtatggattatggaagtctagtaaatatacttttccctaa

SEQ ID NO: 49460 - DNA, 315 bp, Homo sapiens
gaaaaaaaggagagaggacttcctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcgg

SEQ ID NO: 49461 - DNA, 300 bp, Homo sapiens
  misc_feature 52, 108, 202, 218, 276: n = A,T,C or G
agaagtgagactgccaatttttgatcctaatagcttttctgactaaacctgntttatagctactatgatcaacatcttctggataccaagtgtttatatgggtagctngacttgagagattgaaatgtttaatgagtggacattaaccttactaatttgtatctgtaagtgaagctaatttgtagcttatttgctgatttgnggatgaccctatttgngggctggacccaaattatttgctctctgaaatagcagggggtaggctggtatctgctnattacttcctccaccccgccttct

SEQ ID NO: 49462 - DNA, 307 bp, Homo sapiens
acagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaac

SEQ ID NO: 49463 - DNA, 318 bp, Homo sapiens
ataatacctggactttaatggcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaaagattttccag

SEQ ID NO: 49464 - DNA, 286 bp, Homo sapiens
acgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcc

SEQ ID NO: 49465 - DNA, 303 bp, Homo sapiens
tgtgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaaagaaagatttttgagactgcagcctattaataaaagttaacataacctg

SEQ ID NO: 49466 - DNA, 208 bp, Homo sapiens
gtaggttgtgtttggattcaagaatcatggattcctgtattttagagctgtgggattgtatgtgattctttttctgggtgatgcatgacacaagtgttgtataccttgtgattttttttttgagcctatgcctataggattttcattatgtactgttaacaaatctactgaaaaggattttcttaaaaaaaaaaaaaaaaaaaaaaaa

SEQ ID NO: 49467 - DNA, 286 bp, Homo sapiens
ctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctgcagacctcagctgcctggtttaccgagctgatacccagacataccagccttataacaaagactggattaaagagaagatctacgtgctccttcgtcggcaggcccaacaggctgggaaataa

SEQ ID NO: 49468 - DNA, 130 bp, Homo sapiens
cttttgccccagaaaggggaaaggaacacgcgggtagatgatttctagcaggcaggaagtcctgtgcggtgtcaccatgagcacctccagctgtactagtgccattggaataataaatttgataaggtgg

SEQ ID NO: 49469 - DNA, 259 bp, Homo sapiens
  misc_feature 30: n = A,T,C or G
tttaattatatattttcatcctataagctnaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacgaaaaaaaaaaa

SEQ ID NO: 49470 - DNA, 300 bp, Homo sapiens
  misc_feature 31, 299: n = A,T,C or G
gacaaagaaaaatgatacttctctttttttngctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactgggcagaacacagattgna

SEQ ID NO: 49471 - DNA, 372 bp, Homo sapiens
tgaagatggcggcctcagcagccgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacaaaaaaaaaa

SEQ ID NO: 49472 - DNA, 302 bp, Homo sapiens
  misc_feature 220, 231, 258: n = A,T,C or G
ttgaggggatggaggaaggcgagttttcagaggcccgtgaagatatggctgcccttgagaaggattatgaggaggttggtgtggattctgttgaaggagagggtgaggaagaaggagaggaatactaattatccattccttttgccctgcagcatgtcatgctcccagaatttcagcttcagcttaactgacagacgttaaagctttctggttagattgntttcacttggngatcatgtcttttccatgtgtacctgnaatatttttccatcatatctcaaagtaaagcattaacatcaaaa

SEQ ID NO: 49473 - DNA, 300 bp, Homo sapiens
  misc_feature 63, 111, 127, 136, 142, 144, 149, 200, 221, 277: n = A,T,C or G
gagcgaagtcagtgccactgaaaatacagaacccattaatatcgtggctatctgattacattnatattccaagatgaaccttttttatatatgctaaaaattttggggaanatgttttgggatgtantatggagcnaaaacncnaaccncttaatagttttatagaacttaaaatttttttatacaattacccaattggngatatgatcttaagcttttgngcagattatttaatatgatgacttcatgctttattatgccttattatggctgacgnattactggggggaaacaaaatat

SEQ ID NO: 49474 - DNA, 332 bp, Homo sapiens
atggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgc

SEQ ID NO: 49475 - DNA, 300 bp, Homo sapiens
  misc_feature 161, 209, 251: n = A,T,C or G
aagatcctggggccattatcctactccaagatcaagcatttgcgtttggatggcaatcgcatctcagaaaccagtcttccaccggatatgtatgaatgtctacgtgttgctaacgaagcactcttaattaatatctgtatcctggaacaatattttatggntatgtttttctgggggcagttttcatagtatccatattttattactgnttattacttccatgaattttaaaatctgagggaaatgtttgnaaacatttattttttaaagaaaagatgaaaggcagcctatttcatcaca

SEQ ID NO: 49476 - DNA, 300 bp, Homo sapiens
  misc_feature 189: n = A,T,C or G
ggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgnggactgaatctgcttgttgatcaagtgttgaagaaagtgcaaaaggaacttttatatatttgacaagtgtaggaaattgtctattcctgatataattactgtagtactctt

SEQ ID NO: 49477 - DNA, 317 bp, Homo sapiens
tggagctgggggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatag

SEQ ID NO: 49478 - DNA, 342 bp, Homo sapiens
atcattgctacaggtttttaaaaaagaacctttcactagctagcacatgccagaggttcacatctgctttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgt

SEQ ID NO: 49479 - DNA, 300 bp, Homo sapiens
cgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgctgcaggatgagattcagaatatgaaggaggaaatggctcgtcaccttcgtgaataccaagacctgctcaatgttaagatggccttgacattgagattgccacctacaggaagctgctggaaggcgagg

SEQ ID NO: 49480 - DNA, 314 bp, Homo sapiens
gacacattattactagtgttaactttgttagacttattgtcatgtctggttcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcaaaaaaaaaaa

SEQ ID NO: 49481 - DNA, 319 bp, Homo sapiens
ttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaacgaacagtgtaccttttaacagtgtaaatcacggaatatc

SEQ ID NO: 49482 - DNA, 300 bp, Homo sapiens
  misc_feature 91, 161, 196, 248, 289, 296: n = A,T,C or G
aacttttaacaacagccatgttgttttccaaagtagttgtgccattttacattccaaccagcagtacaattttcttttcttgtaatgttcncgtctcgttgggtatcagagtattgcaggcctcatagaattgggaagagtactccctcctcttcaatttnctgaagagttatataagaattggattattttatgnaaggattctatacaattcaacagttaagcttttgagcctgaagtttctttgnagggaaggatatttagaaatatattccatttccaaatattngggaatnatcc

SEQ ID NO: 49483 - DNA, 330 bp, Homo sapiens
tgacaaacccgatatggctgagatcgagaaattcgataagtcgaaactgaagaagacagagacgcaagagaaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaaggttaaatgactgtgctgcccctttcacatcaaagaactactgacaacgaaggccgcgcatgcctttcccatctgtctatctatctggctggca

SEQ ID NO: 49484 - DNA, 366 bp, Homo sapiens
agcatgccttttatggcgaaatgtgtttgaacttcaaacaacaaatatataaaacttattatgcaatacaccctatcagcaaattaattgaaggctgcctctagattgttaggtgtggatgacaggaactttatttcatacttcttttgtacatgccattgctgtttaacagtgttgggttcataacaggtgattagacagtcttgttgatagtttggagaaccatcttaatcatgacctagaatcattcttatttcacagcaacctgtgtcttgactaatgttaaactgactaatttgttttgaagctgagaatgagaaattggaggtccttctcatagatctgagattcctttttattcctgag

SEQ ID NO: 49485 - DNA, 300 bp, Homo sapiens
  misc_feature 270: n = A,T,C or G
atactggaaacctaactgcaatgtggatggtttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagncttctgtaattcattgagcaggtagctcat

SEQ ID NO: 49486 - DNA, 377 bp, Homo sapiens
aaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttg

SEQ ID NO: 49487 - DNA, 204 bp, Homo sapiens
cagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctgaaaaa

SEQ ID NO: 49488 - DNA, 300 bp, Homo sapiens
gtttggtttggagagtccatggatggtgggtttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggcaaatgaaggtgaattcaaggctgaaggaaatagcaaattcacctacacagttctggaggatggttgcacgaaacacactgggggaatggagc

SEQ ID NO: 49489 - DNA, 135 bp, Homo sapiens
  misc_feature 18, 21, 39, 48, 58, 77, 83, 97, 112, 125: n = A,T,C or G
ggggtgctagaatcaganaangggaacattatgatccangaacacgangcatcacggnggcagtgcacaaaaggccncttganctcatatctgtgcntgagcagcctgtcanaggaacgggaccnacctatgtta

SEQ ID NO: 49490 - DNA, 217 bp, Homo sapiens
ttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaaaaaaaaaaaaa

SEQ ID NO: 49491 - DNA, 300 bp, Homo sapiens
ggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaa

SEQ ID NO: 49492 - DNA, 299 bp, Homo sapiens
  misc_feature 28, 183: n = A,T,C or G
ggaacacctatacctacaaaataatganatagaaaagatgaatcttacagtgatgtgtccttctattgacccactacattaccaccatttaacatacattcgtgtggccaaaataaactaaaagaaccaataagctcatacatcttcttctgcttccctcatatacacactatttattatggngaacaacgaagcactaatggtcaaacaatacaactaaagacacaagttttcaggagatttccagatgatgatgaaagtgaagatcacgatgatcctgacaatgctcatgagagccc

SEQ ID NO: 49493 - DNA, 218 bp, Homo sapiens
agaaagctggcaggcgagtagtagaatcagagtacaggctgagcatcccaaatctgaaaatccaaaatcggaagtgctccaaaacctgaaacttttggagcaccaacacaatgctcaaagtaaatgctcagtgaagcattttggatttcatattttcagatttgggtttgcccaaccggtgtaatacaaatattctaaaaaaaaaaaaaaaaaaaaaa

SEQ ID NO: 49494 - DNA, 184 bp, Homo sapiens
  misc_feature 37: n = A,T,C or G
aaagtcctaatagtagaagaaccctccataaacctgnagtgactatatggatgccccccaccctaccacacattcgaagaacccgtatacataaaatctagacaaaaaaggaaggaatcgaaccccccaaagctggtttcaagccaaccccatggcctccatgactttttcaaaaaaaaaaaaa

SEQ ID NO: 49495 - DNA, 186 bp, Homo sapiens; identical to SEQ ID NO: 48905

SEQ ID NO: 49496 - DNA, 224 bp, Homo sapiens
  misc_feature 144, 146, 152, 177, 189: n = A,T,C or G
tgcaaccagtgcaagtgaccgacaaaattccagttatttatttccaaaatgtttggaaacagtataatttgacaaagaaaaatgatacttctctttttttgctggtccaccaaatacaattcaaatgctttttggtatatgttntnaccaantccaatttcaaaatggctcaatggngctataataaanaaacttcaacactctttatgataacgaaaaaaaaa

SEQ ID NO: 49497 - DNA, 181 bp, Homo sapiens
attaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatggaaaaaaaaaaaaaaaaaaaaaaa

SEQ ID NO: 49498 - DNA, 229 bp, Homo sapiens
cctagcaagtgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatttcaaaaaaaaaaaaaaaa

SEQ ID NO: 49499 - DNA, 175 bp, Homo sapiens
agacatactgtggggtgcaatattaacaatattaaatgcaaatttctttggataaattatttctatattctgtaaatctgagatttaatgtatattttgtttaaaaaaatgatttagtaaaatctttgaaaagtatgatcttctaaagtaaaaaaaaaaaaaaaaaaaaaaaaaa

SEQ ID NO: 49500 - DNA, 234 bp, Homo sapiens
gtatacaaatttagaattaaaatgttttctatttttttcatgattaacttagtgaataacttaaatccttaatcctcgtagtggttagaaagatgaggagacctttttgacttacatttgtaaatgaaaacaagtctgtgaatattcagatgactacttcgaagtaattcagtttttttattagtatttttccagcttgtgttttcccatgagctattttactttgctgaattt

SEQ ID NO: 49501 - DNA, 274 bp, Homo sapiens
  misc_feature 24, 48, 81, 94, 106, 136, 163, 240, 248, 252: n = A,T,C or G
ggagtcatcacttttataaatagnggtcagagaccacagagagagacngcttcatcgaatgggaagtaccaaggagaaagnacaattcagtatngctggagcaagnggcactttggacctgaggttagaataaggnggctcttgccagacaatccccaggcgnttctggggtcagaaggaggaagaatgcctttaatcagaggatatctaagctcttaaagcggtttttctccatggcanaaggcctnctcngaaaaaggaaggacagggatcc

SEQ ID NO: 49502 - DNA, 300 bp, Homo sapiens
agaatattaaaaccaacaaacgattttagcaaggttccaggatacaaactcagtgtacaaaaatcagtaacatttctctacaccaataatgttcaatctgagagccaaataaagaatgaaatcctatttacaatagccacaacaaaattaaatacctgggaatacatctaaccaagggggtgaaagaactctatgaggagaacttcaaaatactgttaaaagataacatagataacacaaacaaatggaaaaacattccatactcatagattgcaagaatcaatatcattaaaatagcca

SEQ ID NO: 49503 - DNA, 300 bp, Homo sapiens
  misc_feature 15, 30, 42, 81, 86, 184, 261, 265: n = A,T,C or G
tcacttccagttagngtgaatgaaaataanaattttctactnggagttgaagagggcagaatccgcaggtctcatcattgngatgngtagcatgtctgccctctgactggcatcattgccattaactttcttctgggcatcacggcaatgtcacgatgcccagacttgggagcaaggcaacctngggggcagtccactcataaaatatggtaacacccattttaaaattaaagtttggccttaaagacaacttcagtggtnaatnataaaagtggggtacttcggcctaaataaattggt

SEQ ID NO: 49504 - DNA, 300 bp, Homo sapiens
  misc_feature 68, 231, 287: n = A,T,C or G
ccatctgcagtattataaaaggcattgagaaggtcagggggataatctagaggcaggattttggacantgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggntacatttgctttccgcgaaatgctcagaaaatgcaggacattccttttccaattgngtgtcaagtgcgt

SEQ ID NO: 49505 - DNA, 165 bp, Homo sapiens
actgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaagg

SEQ ID NO: 49506 - DNA, 296 bp, Homo sapiens
  misc_feature 185, 256, 287: n = A,T,C or G
cattgagacacattacctggaatgagcaggtgaaagccatcaaagaattggggtgaccacgtggaccaacttgcgcaagatggggagcgccgaatctggcttggcggaatatctctttgacaagcacaccctgggagacaagtgataatgaaagctaagcctcgggctaatttccccatagccgnggggtgacttccctggcaccaaggcagtgcatgcatgttgggggtttcctttaccttttctataaggtggnaccaaaacatccacttaagtctttgatttgnaccattcct

SEQ ID NO: 49507 - DNA, 300 bp, Homo sapiens
  misc_feature 50, 66, 84, 94, 115, 153, 165, 175, 183, 218, 227, 233, 239,276, 280: n = A,T,C or G
gtaatgatatatatagaaagagctcattttatatacatagaagtgtatgnggataatctcatgtcnataactaattgtatgganattttgtaantatatagatacacatataaantttgcatctatagctatagtcctagcatgaatataagnatggtgtggganataaaagctntacatacnttgacatacaataggacttacaggatgagccgganatgattatnaatctnggagcnataaagcccacccagctggaggatggtagagaggggncagnccaggaacattgcctggata

SEQ ID NO: 49508 - DNA, 109 bp, Homo sapiens
  misc_feature 40: n = A,T,C or G
caactgacaaaattgaaatatggacagtagacaaaaatantgttctggccaggatgaagtaacagggaccagatttaccctcttaccttaaactaaacaaccagaaaaa

SEQ ID NO: 49509 - DNA, 155 bp, Homo sapiens
  misc_feature 20, 65, 66, 106, 109, 126, 149: n = A,T,C or G
ctgatagagtgcactcattnataatcagaggagagactgtctagaagttggggcagatgtatganntaagtctgtaacatgatataactgaatggagtaccctagnttngataagctattaggatnttgtaatagaactgactcccccngcctgc

SEQ ID NO: 49510 - DNA, 202 bp, Homo sapiens
  misc_feature 39, 51, 53, 80, 85, 178: n = A,T,C or G
acatggtcaggcaaggggcctatggtggttccatggggngctaaatggggngnggggacaaggatcaagcggtggctttncttancgaggagcagaaaatcggttggagaaagtggttgaagggcacaagcacaggagtcagaaaggctaaataaaaaaatggaaacttttttggagnaataaaaatggaaaagacgctggc

SEQ ID NO: 49511 - DNA, 300 bp, Homo sapiens
  misc_feature 18, 32, 34, 76, 254: n = A,T,C or G
gttttctcacttaccttntttaaaagaagaangnggccattagcctccggttctggcatgggattaggaatggctnattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctggaacaatgtnatcagtaatgctttaaactccagcacctggtatgcatttgaaacca

SEQ ID NO: 49512 - DNA, 237 bp, Homo sapiens
  misc_feature 51, 65, 78, 97, 133, 171, 181, 211, 221: n = A,T,C or G
agcattacccatgggaaaaaaaaactactgttaacactgctaatgaaagangaggccttttaacnccctaatgattgnagataaacataatatgtgnctttttcacaacatcctatgatttttagactaggcnctagtattcatgaaattatccatgaaattatccatggnaaaaattagntacaaaaattacataattcaaagataatgntggtattctnaagccttatataatat

SEQ ID NO: 49513 - DNA, 238 bp, Homo sapiens
ggctccctgtgaaggattaacttacagagaagcaggcaagatgaccttgctgcctggggctgctctctcccaggaattctcatgtgggattccccttgccaggccggcctttggatctctcttccaagcctttcctgacttcctcttagatcatagattggacctggttttgttttcctgcagctgatgacttgttgcctgaagtacaataaaaaaaattcattttgctccagcaaaa

SEQ ID NO: 49514 - DNA, 175 bp, Homo sapiens
  misc_feature 7, 31, 47, 53, 66, 95, 98, 114, 120, 145, 157, 158: n = A,T,C or G
atctagntcactctccatttaataattatangctatttctatatttncattcncctatcacctgcntgcctttttcattattttattatgaaacntgngtaaatacaattttgnttctgnactttttggcataacataaatctgngaacttgaaatnngaattttgggtagagaa

SEQ ID NO: 49515 - DNA, 300 bp, Homo sapiens
  misc_feature 94, 108, 204, 239, 282, 293: n = A,T,C or G
aatcaattgtgctgacaacacaggagccaaaaacctgtatatcatctccgtgaaggggatcaagggacggctgaacagacttcccgctgctggngtgggtgacatggngatggccacagcaagaaaggcaaaccagagctcagaaaaaaggtacatccagcaggggcattcgacaacgaaagcataccggagaaaagatggcgnggttctttattttgaagataatgcaggagcatagngacaataaaggcgagatgaaaggtctgccattacaggaccagnagcaaaggagngggcaga

SEQ ID NO: 49516 - DNA, 211 bp, Homo sapiens
  misc_feature 5, 12, 29, 42, 60, 65, 89, 135, 145, 162: n = A,T,C or G
caaantgaaccnactagagaggcatgttnacaaaaaaatgtntataacaaagaaaataancaaantggagctgattagataatacaagngtaagaggatctatcaatagtgaaaaacattcattttaattccatntatataaagntttcaaaaatatatctntaatacattgcaatttattacattggtgacaaaactctaaagtgaaaca

SEQ ID NO: 49517 - DNA, 521 bp, Homo sapiens
  misc_feature 21, 33, 58, 82, 111, 114, 117, 138, 162, 185, 197, 213, 214,215, 216, 221, 222, 226, 246, 268, 287, 305, 309, 334, 357,358, 370, 371, 379, 390, 398, 399, 401, 403, 405, 426, 428,429, 433, 439, 446, 451, 466, 470, 480, 482, 494: n = A,T,C or G
  misc_feature 495, 507, 511, 514, 515, 518: n = A,T,C or G
gagacatatacatatgtttgnattataaattgnaagcaatcagtttgagatactaggntttatcacctgctgctggatgtgnaaacaaagacaaatggtgctttaagaagnaancanaattaggaataggctatggangggagacttggaatttttaaaganaaactgggggctttgggggatanacccggaaactnttttaaaaaaaggatnnnnagggnncacngattttcaggtaatttaatncttaaggcccaatccgggctcnctgagcaaggccagagccnaataaacggaaaattggngggnaaaaaggaagaaaaaggggccgganaaccttttggcaggggaccgganncaccaagggaanngggaaccnccctccccggnaaaccctnnangnanagggggggcagggggggggantnncccntccttnaaaggcnggggnaccccggggaaaccngganacccgggatntnggaaaaaagggnngggggggaaccntccnggnnggnccc

SEQ ID NO: 49518 - DNA, 300 bp, Homo sapiens
  misc_feature 25, 31, 63, 84, 119, 185, 268, 270, 292: n = A,T,C or G
tgttgtatcagtaaataaacatagnggcggnttactgatgagtatctcccagaacaacgatcncacctctacgggataactgcngtctacccctactgcccaacaggaagaaagtaagnacagtaatgtaaaggaagacttggagtttacaatcagaacctggaccctaaagaacagtgactgcnaaggcaaagaaagtaaaaaaggaattggccattagacgttcctgagcatccaagatgaacattttgagggcaaaaagactttngngaaaagctgatacctcatcttnactactgg

SEQ ID NO: 49519 - DNA, 120 bp, Homo sapiens
  misc_feature 40, 64, 102: n = A,T,C or G
gcatttgcgtttggatggcaatcgcatctcagaaaccagncttccaccggatatgtatgaatgnctacgtgttgctaacgaagtcactcttaattaatatcnggatcctggaacaatatt

SEQ ID NO: 49520 - DNA, 300 bp, Homo sapiens
  misc_feature 21, 104, 190: n = A,T,C or G
aaacccaaagtcagtagaaanggaaatattggagatcagagtggaaaacaatgaaataggaaacagaaacccaacatagacaaagcaaccaaaagcttattttnggagaacagttaatgaaattcatcagcttccagccagattgatcagagagaagacacaaattaacagtattagaaatgagagagtnggcataacacagattttatagatattaaaatgataagaatatattataaaaagtttatgctaataaatgtgaaaactgagatgatgtgacaaattccttagaagacacaa

SEQ ID NO: 49521 - DNA, 108 bp, Homo sapiens
  misc_feature 23, 31: n = A,T,C or G
cttagataatacattcaaggggnataaaggncaaaaagggcaaaggggaaacagggaaaaaaggccagcggatccctagggcaggcacctaggtcccatgcactaagg

SEQ ID NO: 49522 - DNA, 239 bp, Homo sapiens
  misc_feature 34, 157: n = A,T,C or G
ttctcacaagagttcagcacaaaacaagtgttantaagagagattttttggcttaaattggtacgttaaatatgcttctgttttaaaatattttaatttcatagagcaattttacatgcagaatgtgatcccacttgttcaaatcttggaccgtggnagagaaatgttttggaaagcagcccactttgacctcttctttcccttttatctcgacatctgggagttttaaagccaaaaaa

SEQ ID NO: 49523 - DNA, 113 bp, Homo sapiens
  misc_feature 73: n = A,T,C or G
aaagtagccaatgtttctcttttggcctatacaaaggcaagaaggaaagaccaagatcataaatattaatggngaaaacactgtagtaataaattttcatatgccaaaaaaaa

SEQ ID NO: 49524 - DNA, 295 bp, Homo sapiens
  misc_feature 61, 69, 121, 151, 162, 226: n = A,T,C or G
tctccagcttcagctcaactcacagcttctccaagcatcaccctgggaggttcctgagggntttcccgnaaatgagggctgcacattgctgtctgcttcgaagtattcaataccgctcagnattttaaatgaagtgattctaagatttggnttgggatcaanaggaaagcatatgcagccaaccaagatgcaaatgttttgaaatgatatgaccaaaattttaagnaggaaagcacccaaacacttctgctttcacttaagggctgggcccgcaatactggaggaacaagcatga

SEQ ID NO: 49525 - DNA, 226 bp, Homo sapiens
  misc_feature 33: n = A,T,C or G
tacacatgtatttacaaaaggaagcaatgaagngataaactaaaacctaataaaaatagttaattctaaagggagtgagagaacaggaaggaggggacaagaatggaactaagactttaaattaccttgttttatgattttcattttggacataataaacaatttaaatgtagaaaaattgaaaatatagaaaaataatgacaaaaatgcacaaacaaccaaaaaa

SEQ ID NO: 49526 - DNA, 213 bp, Homo sapiens
  misc_feature 56, 126, 140, 158, 170, 173: n = A,T,C or G
tcaggctcacagcccttttataaacatgcctggattggatgatggcttcagtatcntttggaaatctggactgagcaatagaattgcttctctcaaattgatttcaagtcatataaaaggccatgntacacatatattgntaatctgagggaggctgngatcatttaagntgnattttataagcctagggaccaccagtaagaaaacaattcc

SEQ ID NO: 49527 - DNA, 140 bp, Homo sapiens
  misc_feature 18, 32, 36, 40, 66, 78, 110, 112: n = A,T,C or G
acaagcataaaccccaanccttttacattttngggnaggnggattaattttttaaaagtcttcttntcatggtaaagnagcaaacaagggcttttactatctttttcatntnattaaattcaaattaaaaaccattacct

SEQ ID NO: 49528 - DNA, 230 bp, Homo sapiens
  misc_feature 95, 165, 197: n = A,T,C or G
ccgaatctggcttggcggaatatctctttgacaagcacaccctgggagacagtgataatgaaagctaagcctcgggctaatttccccatagccgnggggtgacttccctggtcaccaaggcagtgcatgcatgttggggtttcctttaccttttctataagttgnaccaaaacatccacttaagttctttgatttgnaccattccttcaaataaagaaatttgggaccca

SEQ ID NO: 49529 - DNA, 144 bp, Homo sapiens
  misc_feature 63, 115, 127: n = A,T,C or G
actgggtatgacttgatccaagtgtttaacaattggggctggtaagtctgaccatacatcacngtgatagaatgtgggctttttcaagggtgaagatacaagtcttaaccacagngtaacttacagnttcctttaaaaaaaaaa

SEQ ID NO: 49530 - DNA, 167 bp, Homo sapiens
  misc_feature 11, 28, 45, 95, 113, 123, 137: n = A,T,C or G
attgaaacagnattatataatggttgcntaattataccatgggangctcaagtctattttgattattcattaggattcacttttacctttaaagntacttggagcaaatatgnttacattganaaagccagatatgnttggcaatgaaattacatatcaaggaccgg

SEQ ID NO: 49531 - DNA, 240 bp, Homo sapiens
  misc_feature 76, 157, 226: n = A,T,C or G
aggaaagctacaggcattcaggtttctctggggaactgggatcacctttttggcattttaaaaaatttttacaggnatcaaaaaaaccaaaaatctggcttatggaaacaaaaacatggaagcagggacatatttgggattctatttatttaaaaantaaattctttggcaaaattggaacctctcaactaaaacgggggccatggcaagaattttaactggttangcaggggaggtttg

SEQ ID NO: 49532 - DNA, 300 bp, Homo sapiens
  misc_feature 23, 65, 67, 240: n = A,T,C or G
cccataccccaattacccatttncctaacactaggaaagctgtgtgtctacctctccttcattgngnacacatatatttgtaattatcacaaaatacttactttgctgactttttaaaacatttataatttttcaaaatattcaccaagtatgctaccatatttggccataaaacacatcttaccaatttaaaaagatagatcattatacagagatgccttctctcacactacaacagantaactagaaatcagtaacagagaactggaagagcccaaaatattggaggatctaacatca

SEQ ID NO: 49533 - DNA, 262 bp, Homo sapiens
  misc_feature 66, 86, 148, 188, 234: n = A,T,C or G
tctagaaaatctgaggtttacaccatactgttaagagtccttttgaattaaactcgactaaaacangtgtataactaaactaacangattaaatatccagccagtacagtattttttaaggcaaataaagatgattagctcaccttgngataacaatcaggtaagatcataacaatggctcatgatgnaaaaaatattaaaggatatcaatactaaggggacagtatcactctnatataatatggatcagagcatttatttt

SEQ ID NO: 49534 - DNA, 147 bp, Homo sapiens
accaccctggaacatgcctgagctcggcataatatggtggaggacccaaaagatttgggttatattggtaaatcttaggggaaaaaaaattaaaatccaggaggatcagaacatcaggctttcaggatacaaattggatttactggg

SEQ ID NO: 49535 - DNA, 107 bp, Homo sapiens
  misc_feature 6: n = A,T,C or G
tgaatncaggaagtgtcttctgaatagcagctagccaaataaagcggtgtgtgtgtactgcagctgtaggtgaacttaaaaataataataaaaagaacaaatttaaa

SEQ ID NO: 49536 - DNA, 300 bp, Homo sapiens
  misc_feature 68, 240, 281, 297: n = A,T,C or G
gatatggctggagatcgagaaattcgataagtcgaaactgaagaagacagagacgcaggagaaaaatncactggccttccaaagaaacgattgaacaggagaagcaagcaggcgaatcgtaatgaggcgtgcgccggcaatatgcactgtacattccacaagcattgcttcttattttacttcttttagctggttaactttgtaagatgcaaagaggttggatcaaggttaaatgactgngctgccctttcacatcaaagaactactgcaacgaaggccgngcctgcctttcccatntgt

SEQ ID NO: 49537 - DNA, 150 bp, Homo sapiens
  misc_feature 59, 79, 134: n = A,T,C or G
gggagcattaagaaaatcaacttggaaacaataaaaaagggatgctgccttggactggnatatcgggggacctgggaanaattcacctttgggacggggacacagtggtaaggatacctgcttgttttctaatncatgggaagacatttt

SEQ ID NO: 49538 - DNA, 300 bp, Homo sapiens
  misc_feature 56, 61, 103, 106, 180, 284: n = A,T,C or G
aaatcaacacggaaaaaaattaatcaggaaccccaagggtcaatttcttctttggnggtgnccccaagtaacggaaaatcattaaatgggggggttacaattnggnatacatcctggacttcaaaggaaaaggggaacaagccttaaccaggcaaggcttcaaggcaataaaaggaatgntttacatcatatatttacccttatttacgctggtatgggactctgggtgggaggacatgaaagaatgcaacatttctttaaaatgatcaacatcacatcctggncattactctgggaatc

SEQ ID NO: 49539 - DNA, 226 bp, Homo sapiens
  misc_feature 24, 126, 171: n = A,T,C or G
caaggctgaaggaaatagcaaatncacctacacagttctgggaggatggtgcacgaaacacactggggaatggagcaaaacagtctttgaatatcgaacacgcaaggctgtgagactacctattgnagatattgcaccctatgacattgggggcctgatcaagaatttggnggggacggtggcctgtttgctttttataaaccaaactctatctgaaatcccggaa

SEQ ID NO: 49540 - DNA, 230 bp, Homo sapiens
  misc_feature 49, 91, 114, 130, 146, 148: n = A,T,C or G
agccagaagactgacaaaggcatcctccgccaccagagcgggcacttgngatcctaaaataagcttcatctccgggctgtgcccttggggnggaaggggcaggattctgcagcngcttttgcatttctcntcctaaatttcattgngntgatttctttccttcccaataggggatcttaattactttcagaatattttcaaaataagatatatttttaaaatcctgaaaa

SEQ ID NO: 49541 - DNA, 300 bp, Homo sapiens
  misc_feature 5, 119: n = A,T,C or G
gcaanggccaaaaaaagaaagaaagtgggtccaaaggcaaaggttcggggacaaagctcaaataaacttaggtcttggtttggacaaaagctacctatgataaactctgtaagggaagntcccaactataaacttataaccccaggctggtggtctcttgagagactggaagattcgaggctccctgggccaggggcaggcccttcaaggagctccttaagtaaagggactttatcaaaactgggtttcaaaagcacaagagctcaaggtaatttacaccaagaaataccaaggggtggg

SEQ ID NO: 49542 - DNA, 300 bp, Homo sapiens
  misc_feature 12, 26, 37, 58, 141, 186, 210, 214, 244: n = A,T,C or G
cgcgaagaacantgatgatggcaccncagatcgcccntacagccatgctctggtggcnggaattgaccgctacccccgcaaagtgacagctgccatgggcaagaagaagatcgccaagagatcaaagataaaatcttttgngaaagtgtataactacaatcacctaatgcccacaaggtaccctgnggatatccccttggacaaaactgncgtnaataaggatgtcttcagagatcctgctctnaaacgcaaggccgacgggaggccaaggtcaagtttgaagagagatcaagacaggca

SEQ ID NO: 49543 - DNA, 300 bp, Homo sapiens
  misc_feature 31, 210, 213, 216, 221, 274, 295: n = A,T,C or G
ttttattttacttccattcttgtataacaanctttttattttccctgaatttgatcgtgcttcttggggcaggagagagggttccttaattttctacatacttactgctcattcattcctcagactctgacagcagtataattgtctttctgtgtcttcaaactcaccaggtaacttaccaagtttctttctttctttctttcttttttnttngangattncttggcccatcattcattagttttctattccagactggtgcactcatacaaangcctgagagcataatcatctnggaag

SEQ ID NO: 49544 - DNA, 300 bp, Homo sapiens
  misc_feature 7, 20, 31, 66: n = A,T,C or G
ggggaanggagcaaaacagnctttgaatatngaacacgcaaggctgtgagactacctattgtaganattgcaccctatgacattggtggtcctgatcaagaatttggtgtggacgttggcctgtttgctttttataaaccaaactctatctgaaatcccaacaaaaaaaatttaactccatatgtgttcctcttgtctaatcttgcaaccagtgcaagtgaccgacaaaattccagttatttatttccaaaatgtttggaaacagtataatttgacaaagaaaaatgatacttctctttt

SEQ ID NO: 49545 - DNA, 300 bp, Homo sapiens
  misc_feature 18, 57, 87, 98, 125, 143, 191, 195, 239: n = A,T,C or G
gaaagacaaagacccagngaacaaatccgggggcaaggcaaaaagaagaagtggtcnaaaggcaaagtcgggacaagctcaataacntagtcttgttngacaaagctacctatgataaactctgnaaggaagttcccaactanaaacttataaccccagctgtggctctgagagactgaagattcgaggcncccnggccagggcagccttcaggagctccttaggaaaggacttatcanactggttcaaagcacagagctcaagtaatttacaccagaaataccaaggggggagatgctc

SEQ ID NO: 49546 - DNA, 300 bp, Homo sapiens
  misc_feature 34, 38, 55, 65, 105, 115, 137, 148, 152, 194, 225, 237, 273,291: n = A,T,C or G
taacaccgaacaccatgccggcaattaagttgcngagntctgatggagagatatntgaaggtgangtggaaattgccaaacaatctgtgactattaagaccatgntggaagattngggaatggatgatgaaggagangatgacccagntccnctaccaaatgtgaatgcagcaatattaaaaaaggcattcagngggcacccaccacaaggatgaccctcctccncctgaagatgangagaacaaagaaaagcgaacagatgatatccctggntggggaccaagaattccngaaaggtga

SEQ ID NO: 49547 - DNA, 202 bp, Homo sapiens
  misc_feature 32, 115, 165, 169, 186, 188: n = A,T,C or G
gggcagagatgatcttgaagggcacatacacnaaagtccaaacactatgtcaagatgggggtaaaatccattaaagaacaggaaaaaataattataagatgataagcaaatgttncagcccaatgtcaacccagttaaaaaaaaaaaattaaggcggggtaaaangggngaattaggtggcaaacnanataaagacatatgc

SEQ ID NO: 49548 - DNA, 244 bp, Homo sapiens
  misc_feature 19, 58, 223: n = A,T,C or G
gattttctttaaggatggnttagaaatggaaaaatgttaacaaatgtggcaattattntggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaagttgnctaaaaataaaatgcatttaa

SEQ ID NO: 49549 - DNA, 300 bp, Homo sapiens
  misc_feature 31: n = A,T,C or G
gcataatatagcaaggactaacccctatacnttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagct

SEQ ID NO: 49550 - DNA, 140 bp, Homo sapiens
  misc_feature 7: n = A,T,C or G
gtgaatntagcactcttctaaaaaatcaagtgtaataattacaaaacaaaagcaaaaaccatgtggtattggcatagggatagacatatagatcaattaatagaataaataaactgatacacttatgctctaaaaaaaaa

SEQ ID NO: 49551 - DNA, 300 bp, Homo sapiens
  misc_feature 18, 38, 177: n = A,T,C or G
ctggtattttttttaggntgagagactagatgacaganagagtgaacaaagcaatataactgagaaaaaaagaatttagagttatttaataagcatctgagaatctcctaaacttagggacctggtaggagttagtaatgatgacataaaagaaataagtattgttttcttcttgtnctctctggttgagggccaaggaaagacaagaaatgacatgagaacaattacaaaactgtttatcagcaaggacacacaaatactgagagaacaaagaacaaaagaacaatctaagccagtaag

SEQ ID NO: 49552 - DNA, 300 bp, Homo sapiens
  misc_feature 35, 55, 81, 92, 98, 174, 183, 205, 253, 254, 268, 293: n = A,T,C or G
ttcaaaattatttatagcttcatatgatgttttgnaattttttctattgataccngttttaaaaatattttccaaggaagntgattaaaatnatattnggtaccttttagaaaaagcattgaaatgaggttctcttgctttttcattttccctctgcttatatgctcttcgaanacatcatgnccaacgggatacctattggtcncatgacacccaaaatggatggagagcaaaggggcgcaccatatggaannggtggaaaactatnggaaaggaggaataatgaagaggcnttggggc

SEQ ID NO: 49553 - DNA, 300 bp, Homo sapiens
  misc_feature 21, 33, 154, 201: n = A,T,C or G
aaagcaggctgccttgttctngagatagacttnaaaatgaaccagctctgaaaagtacttctgctgctctggtctatccctgaaaacagatgtcttgaaacacttttcatattcttaaaataatcttcacttctgttaagaagaacatgttggngggtaattatgcgaatgtttccctgccctgatttctcgattaggcgnatgggttttgaaaaagagatttttcagaagattgcagcttcagtattcacgttccatcgggcatctgggctggtaggggagggaccctcaggcaggctg

SEQ ID NO: 49554 - DNA, 157 bp, Homo sapiens
  misc_feature 143: n = A,T,C or G
agcataatatagcaaggactaacccctataccttctgcataatgaattaactagaaataactttgcaaggagagccaaagctaagacccccgaaaccagacgagctacctaagaacagctaaaagagcacacccgtctatgtngtaaaaaaaaaaaa

SEQ ID NO: 49555 - DNA, 219 bp, Homo sapiens
  misc_feature 41, 47, 54, 98, 101, 104, 130, 165, 203: n = A,T,C or G
ctagctgactgacaaaactaagcagggagaataaagatagntgtatnttatggntggcacacaaacgcagaatttgtataaccatatgacttcatagntgnganctcaaaaaagaaggaatttctccttnggttcttgcagttaatggaagaatactttaaatcnctaagcttctgaagggtaagagggaagagatggctagnaaagatggaggagtaa

SEQ ID NO: 49556 - DNA, 123 bp, Homo sapiens
acagtatttttttaaataactcgggtgtatgagaagaaattagaaaagaaaattaacttatgtggactgtaaatgttttatttgtaagattctataaataaagctatattctgtaaaaaaaaa

SEQ ID NO: 49557 - DNA, 300 bp, Homo sapiens
  misc_feature 56, 67, 147, 183, 208, 251: n = A,T,C or G
ggaaatctgaaatacggaatgttttagagaaatatgtcacttgcatatagaatgtnttaattgaggnataaattaatgagacaaagtgaaaaagaaattatattcagataggactgcactacattatttgtcacacatggatctgtnaccatcaggtcaattcctagtatgcataaatttttnaacccttttaaaagagacctatgtnggaaaacccctgaaaattcactggaagaaaaatcattactctntttctcagtaaatcatatcatctggaaatattacaaatttcaaatttct

SEQ ID NO: 49558 - DNA, 172 bp, Homo sapiens
  misc_feature 141: n = A,T,C or G
tgacagtgatgttatacaagcaaacttggaaggcatagtaagcatacctatgctgagagaaaagcatcaaatcctttgggacacatttaggtttattggaacaaagcacttggacacttttaacggttaaaactgagcatnatctttcctttccaggggaacaaaaaaaaaa

SEQ ID NO: 49559 - DNA, 300 bp, Homo sapiens
  misc_feature 30, 65: n = A,T,C or G
atgagtcaatccaaatgctctacaaaaatngtactccagttttggaaacaaggcatctaaatttngatggcttgtggtcaaaataagttgtaatccataatcaagtgttcaaccaatgaaacacaaaaagctcagcctctgaagcctgtaatgaattgcaatgattaaaaacaaaatttgcaaacaggggaccctgaaatatagatgacaagagctcaaactgtatagaagattaaaatgtgaaattctacaagtatgctctggaaattgcttgggggaagatcctttgaaactttaaca

SEQ ID NO: 49560 - DNA, 300 bp, Homo sapiens
  misc_feature 31, 32, 219: n = A,T,C or G
acacaaagggaaagaggagaggcacccgatnnatgttctctaggccttttagaaaacatggagttgccctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgnaaacaaacaagttaagggcaagattcttgccaagagaattaatgtgcgtattgagcacattaagcactctaagagccgaga

SEQ ID NO: 49561 - DNA, 300 bp, Homo sapiens
  misc_feature 21, 25, 38, 128, 285: n = A,T,C or G
gaagaacaaagaccaagaccnagangcgccctcagcgngcaacatccaatgtgtttgctatgtttgaccagtcacagattcaggagttcaaagaggccttcaacatgattgatcagaacagagatggnttcatcgacaaggaagatttgcatgatatgcttgcttcattggggaagaatccaactgatgagtatctagatgccatgatgaatgaggctccaggccccatcaatttcaccatgttcctcaccatgtttgggggagaaggtaaatggcacagatccngaagatgtcatcaga

SEQ ID NO: 49562 - DNA, 220 bp, Homo sapiens
caagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtgataaaaaaaaaaaaaa

SEQ ID NO: 49563 - DNA, 130 bp, Homo sapiens
  misc_feature 28: n = A,T,C or G
ccaacaaacatatgaaaaagtgctcttnatcactaatcatcagagaaatgcaaatcaaaaccacactgagataatattttacaccagtcagaatggctattattaaaaagtcaaaaaaaaaaaaaaaaaa

SEQ ID NO: 49564 - DNA, 138 bp, Homo sapiens
tgaaattgagctgactactaagacgagatccaatttaggaagtgttttgacattacccccagtgagcaatttgagaagcacataagcaaaaataagaaagcattcatgtgggctgcttcatagggttttttttttttt

SEQ ID NO: 49565 - DNA, 220 bp, Homo sapiens
aaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgccaaaaaaaa

SEQ ID NO: 49566 - DNA, 300 bp, Homo sapiens
ggaggctgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttgcttcagctgctgtaagtaaagatgattccattatttcaagtcttgatgcactgatattgcccaagtaggaaaaagga

SEQ ID NO: 49567 - DNA, 300 bp, Homo sapiens
  misc_feature 34, 124, 177, 209, 241, 245, 258: n = A,T,C or G
ctgggctggaggctatccagcgtactccaaagantcaggtttactcacgtcatccagcagagaatggaaagtcaaatttcctgaattgctatgtgtctgggtttcatccatccgacattgaagntgacttactgaagaatggagagagaattgaaaaagtggagcattcagacttgnctttcagcaaggactggctttctatctcttgnactacactgaattcacccccactgaaaaagangagnatgcctgccgggngaaccatgggacttttggcacagcccaagataggtaagtggg

SEQ ID NO: 49568 - DNA, 300 bp, Homo sapiens
  misc_feature 37, 223, 239: n = A,T,C or G
ttcaagcaattctcctgcctcagcctcctgagtagcngggaatataggtgcacaccaccatgcctggctaatttttgtattttcagtagaagcagagtttcaccatattggcaggttggctcgaactcctgacctcaagtgatctgctgctcagcctcccaaagtgctgggattacacgcgtgagccaccacacccagcctccatctttaaacttttaaatgngaaatttctatcatgnaccggtagcctaacaagattttctttcctatttctgactggggcctttcccctttttagga

SEQ ID NO: 49569 - DNA, 180 bp, Homo sapiens
  misc_feature 145, 165: n = A,T,C or G
accatttccgacggcatctacggctcaacattttttggagccacaggcttccacggacttcacgtcattattggctcaactttcctcactatctgcttcatccgcaactaatatttcactttacatccaaacatcactttggctncgaagccgccgcctgatacnggcattttggagatg

SEQ ID NO: 49570 - DNA, 148 bp, Homo sapiens
  misc_feature 19: n = A,T,C or G
catggcatgtgcctgtggnctcagttacttgtgaggctgaggtgagatgatcacttgagcctgggatgttgaggctgcagtgaaccgcgattacaccactgcactccagcctgggcaacacagcgagaccttatcaaaaaaaaaaaaa

SEQ ID NO: 49571 - DNA, 300 bp, Homo sapiens
  misc_feature 62, 72, 122, 151, 164, 230, 258, 289, 296: n = A,T,C or G
gcattttcactatttgacaaagatggggatggaactataacaacaaaggaattgggaactgnaatgagatcncttgggcagaatcccacagaagcagagttacaggacatgattaatgaagnagatgctgatgggaatggcacaattgacntccctgaatttcngacaatgatggcaagaaaaatgaaagacacagacagtgaagaagaaattagggaagcattccgtgnggttgataaggatggcaatggctatatnagggctgcagaacttcgccatgggatgacanacctggngaga

SEQ ID NO: 49572 - DNA, 190 bp, Homo sapiens
  misc_feature 12, 16, 30, 61, 71, 74: n = A,T,C or G
gaaagattccgnttancctgccattgcttngaaaagcagcaggaaacgaaatcctttgacntggatcagcntcngcagagcatctttggtttcctttggcctttggttcctaccttttgaatcagattccgtttagcaggaagacctcttgggaccattcctaggaacctgaaatttcttttttaatcgc

SEQ ID NO: 49573 - DNA, 300 bp, Homo sapiens
  misc_feature 9, 16, 25, 27, 44, 58, 74, 93, 115, 120, 250, 295: n = A,T,C or G
atttatgtnaaaaaangagaggacncngtggaaacgggagacantagaaccatgggtntcccagggatgcaccncaatgagaggggtcacatngataaagagacggcgagcgacngaagnctatgattaacactactttgatcatcaccaacataccctacatcatcatggcgctggggggggtctttggttggttcctacctggcttgcatgcaaaggacagggatccatggatgagggaacagcggangaaagagcacccctcattcgaacctaaacattgcctttgcttggngaaga

SEQ ID NO: 49574 - DNA, 299 bp, Homo sapiens
  misc_feature 11, 22, 53, 63, 65, 129, 231, 240, 269, 273: n = A,T,C or G
ggctgttctgntgatgtaaatnatttttttccagattggcacatgaaatattnaaactttttngngggcctttctgtccaaatgttgcatagttaccagggaagattagtccagggattacataagagntgggcaccaaattctctatattttgcctcccatggaggctttgaaatgcatctttattaaaaatcaaaatataaccaggataccgaaaggcaggatatgaangggaaaatnggtacatatcctattcatgccattctggnaggnggactggaatttttactggaggagga

SEQ ID NO: 49575 - DNA, 300 bp, Homo sapiens
  misc_feature 31, 67, 255, 277, 290: n = A,T,C or G
tcattgtcctaaatcaccctgactctgaccngtctttcagttctccaaaagcccaatttaattgtanagttttgtcatggcttcatataataaagagcctattttaagttgaaagtagtagcagaaaattgttaatttcctaaagctcaggaaactagggtgcactttttttgcactgcagcatatacactaactagcttattaaaatttacaaaatgtctttttgaatgtatcaagggtatatttagtttgagnggaatttgcagcagatatcagnaacttattgccgnttatattgga

SEQ ID NO: 49576 - DNA, 283 bp, Homo sapiens
  misc_feature 213, 249: n = A,T,C or G
gaatgagctcgctgacacacagcctaaatttgcccgcatgtttcatactaactccctctgagtttgcacatgggacccatgaggaggcatgaagaggtaactgcccatgcccgaggattttccagcccttccttttctttctatcaatcacctactaatcacagaatccactccctacaccttttctactaaaataactctttaaaataagtncaatgggacagatttgagctggctcctgctccttgntaatcaaattgcaataaaatgttttcttttgctc

SEQ ID NO: 49577 - DNA, 208 bp, Homo sapiens
  misc_feature 145, 160, 172: n = A,T,C or G
cagctcttcaggagaagcacgccatgaaacaggccgcatggaaatgatgagtcagaagattcagcagctcacagccctgggggcagctcaggctactgctaaggcctgagagtttttgcagaaatggggcagagggacacccttnggcgtggttcctggngatgggaagggncttgtgttttaatgccaataaatgtgccagctgggc

SEQ ID NO: 49578 - DNA, 300 bp, Homo sapiens
  misc_feature 65, 80, 82, 144, 198, 273: n = A,T,C or G
tgctatgggaagacactcaaggatggggattcaaggatggaatttttcataactccatatggctngaacgagcagccggngngtaccacagagaagcacggctgcaaatacaagctcacctacgcagaagctaaggcggggggngaatttgaaggcggcatctcgcaacctacaagcagctagagcagcaagaaaaantggattcatgctgggctgctggatggatggctaaggcagagtgggataccccattgggaagcagggcccaactgnggatttggaaaaaccggcattaatgat

SEQ ID NO: 49579 - DNA, 300 bp, Homo sapiens
  misc_feature 28, 36, 71, 90, 110: n = A,T,C or G
cagcaggatattgataaacaggacctgnacagaagngccctggaagaaggctgctctaaattatccagggnatggagaaacgacacaggntaggagacgcgcttgaacgngctataggacttctcaaacacacaccatcagaattcaatattcacctgccagactggcttatcaagacaaaggggccttcataatgaaggtaaagggaggatactggggagaggacttccaaatgtgggtacctcagctatatcactgcccaacatcagaaaacctgacgctatgaatactatgcctttt

SEQ ID NO: 49580 - DNA, 237 bp, Homo sapiens
  misc_feature 61, 64, 83: n = A,T,C or G
agccagcggcaggtttaacagctagaactaaatagaaagcgagttgtccgcagataggagnagnctttattggcctggacggncggtggcagggctattctgagatctggagatgcttagaatatcaggattttggatgttggtggattttacaatttatttggagcttctttattttcccccagatatatgaaaaaatgcaatacctggttatatcatggaggaaaagcttagcaa

SEQ ID NO: 49581 - DNA, 250 bp, Homo sapiens
  misc_feature 23, 31: n = A,T,C or G
ctaaactaatagaaaatcgaaanaatctttntataaatttcctgaaattctgctgatcctttttgttttggttttcagagtcaagaaaacttttttcctgttgaactagttatatcttttaacaattaactactatatattcctataagcaaatttggagcatgtttctttctacctgatttctttagaatttggaaactatttgtgactattcttaacttatgacaatatagttatttgcataagttcc

SEQ ID NO: 49582 - DNA, 175 bp, Homo sapiens
  misc_feature 50, 56, 72, 76, 93: n = A,T,C or G
gcttaaattgctacagtaattcaagagacagccctgtctggacacagagntactgnggatttttaagagacncagntaaagaatttaggaatntctgattcatttaaaggatttacaaattcatcaacccctgaaaactaaagcaaattgaacaggaaaaaaaaaagaagatggg

SEQ ID NO: 49583 - DNA, 300 bp, Homo sapiens
  misc_feature 26, 32, 62, 87, 109, 131, 174, 178, 202, 203, 226, 241, 242,280, 299: n = A,T,C or G
aaaaacaaatatagatagggagaacnatattnccccccaatcagaatcatcatatcataggnacaatctttcaccaagtaaatttgnataaataagcactattctttgnattaccaaagcaaggtacaggngactaccctagtcaaaacaaccactttctcaggcttctcatgngtgnagctaagctaccttgcatatgggnngattcctgaaaaccgggacgggnatttccattgggggnnggccatttatgctgacatgccatccttccagcaaacgnacgggaatgggcttcaatng

SEQ ID NO: 49584 - DNA, 300 bp, Homo sapiens
  misc_feature 36, 78, 212, 227, 229, 243, 267, 273: n = A,T,C or G
gggagcaataggaaagcatatgcagccaaccaagangcaaatggccggaaaggatacgaccaaaactccaaggagganagcacccaaacacttctgcttcacttaagagctggccgcaatactgtaggaacaagcatgatcttggtaccgggatattttaaaaatccacaggactcactttttccaaatgatcctaggaattgcctagaaanatctttctcttaccngnatttatcaattttncccaggattttatacggaaaaaantggatngaaaacacttaggatgcaggtgaaaag

SEQ ID NO: 49585 - DNA, 164 bp, Homo sapiens
  misc_feature 17, 110: n = A,T,C or G
gggagagggggagggangacagaggcaggttggtttagaaccagccggattttacatgaagctggataattaattgcaagtatttgtggaagcaaagattaaatgggcantggaaggcatccctttttttacatttcatacaacagaaaccagaaaagcaatac

SEQ ID NO: 49586 - DNA, 616 bp, Homo sapiens
accaaaggaatcatgctggagatctactgtacaatacagggcctatgattgacaatccgatgtggtatactgaagcatttgctaagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgcaaatcactgatgaaaatggatgacgcttctatttccaggaatattccctggcttttgaggcaataaagcaagcaagtgaatgggtaagaagaactgaaggacagtacccatctatctgcccacggttggactggggaacgactggactctgccaccaagcagttgctggactccagcccataacactgtgcccctcttatagagtctccatacagcaaggctaagtcaaatgaactgaattttaactttttgctgcttctttgtggaaataatcaaatgatattggttccttttaaggaacctcattaaggttcattcaggggagcaattactgg

SEQ ID NO: 49587 - DNA, 166 bp, Homo sapiens
gcctgcaaatcgctctcttgctacagaaagatctaaaagatgacaactgtcacaaccttgcggaaggagttgctgacctgacacagattgatgacagatggccaggatcacgtctgggatggtaagcgatgaaatatgacctgttactgggacttcagcgaattgc

SEQ ID NO: 49588 - DNA, 529 bp, Homo sapiens
tgttttgctgtgatgttacataggttgatttgtatgtagttttaatgcacctataacaaaatgtgttggtagcagattgtccagaaagcattttaaatgaagaggtataaacccttaagggccaaaattctgtatattagattactcttaaacgaaaaaccagctgccggttttatgtacacatattacatacgagtaggcagcagactttaaaaataaaaaaaacctaggcatgttgatgttgcaaaatgctgtataaagctgaaacctgttcattcagtccattgtagttgacatgaagcgattgtaaaactgctccgatttttctctgggttattaaaatgctaactataatattttttgtgaatcctttgaatgttcctaacagttgtgatgtactgttccgtttatgctcttatccaagtcatttttaatggtttggaagccatttttgtaatgaataaatgtcatgctgacagtatctgtagcatgccgtcttggattaataaaagcacttaggatggcaggt

SEQ ID NO: 49589 - DNA, 147 bp, Homo sapiens
  misc_feature 50, 59: n = A,T,C or G
acttctcaccatttgagttgcccatcttgtttcacactagtcacattctngttttaagngcctttagttttaacagttcactttttacagtgctatttactgaagttatttattaaatatgcctaaaatacataaaaaaaaaaaaaa

SEQ ID NO: 49590 - DNA, 476 bp, Homo sapiens
  misc_feature 228, 240, 410, 445: n = A,T,C or G
aaccccgacacagtagcatttgaccagtgtctggttggaatggtgacaacatgctggagccaagtgctaacatgccttggacaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggnactgttcctgtngccgagtggagactggtgttctcaaacccggtatggtggcacctttgctccagtcaacgttacaacggaagtaaaatctgtcgaaatgcaccatgaagctttgagtgaagctcttcctggggacaatgtggcttcaatgtcaagaatgtgctgtcaaggatgttcgtcgnggcaaccgttgctggtgacagcaaaaatgaccccncaatggaagcaggttggcttcactgctcagg

SEQ ID NO: 49591 - DNA, 298 bp, Homo sapiens
  misc_feature 58, 81, 119, 136: n = A,T,C or G
ttaacacttaagtatattttggaacagaagaaaaatgaaaattagtatatctgcgctncataattatcatattaaagagtngagtcgattttagcaactaaactattgctctccaaatntccttaattcattaaanaaaggggttaaactagaagacgatctctgatatcttttcaccttaaggcaacaaatctttgtagagtatttgtgaattaaatcctttatgaaaaggtgtcccttgtaaatgattggggcatgttgctcttttccttcatatttttagtttctgctattcata

SEQ ID NO: 49592 - DNA, 318 bp, Homo sapiens
attagataacactggcttaaagtattacaacacagtagggcgtggtggctcacgcctgaaatcccagcactttgggaggccgaggagggaggatcatctgaagtcaggagttcgagaccagcctggccaacatggtgaaactccgtctctattaaaaatacaaaaattaggcaggcatggtgacacaagcctggggttccagctacttgggaggctgagggaggagaattgcttgaacccaggaggcagaggttgcagtgacctgagattgcaccactgcactccagcctgagcaacagagcgagaccctgtctcaaa

SEQ ID NO: 49593 - DNA, 484 bp, Homo sapiens
  misc_feature 333, 353, 359, 400: n = A,T,C or G
ggtgccattagcctttcacttaatgagtattttcacgtacattgtcacatttgatcattcagtgaggtatggggtgaattatatgaaattgctgatatttgaccattgtggagcacaaaagcagcaattttatgtggttgaatatggcattattaaacctacttttgagatgcagaaaagtgaggcttaaagcaaatgtgacttaaaaaaaatcataaagctttcagcagcagagctaaactaagtctcatgactgcaaaattctatgattttcccatattgccactactgaactggcagccagccacccatttgtatttccttaatacaagnaaatgctaatcaaataggangaaatnaatccggatattttaatgactcaaaactggaggaggtaaanagcttccggaatttggtttggaaagggtcccattcttttctaccaaggaagaataaacatggggattctgaggcaccataattt

SEQ ID NO: 49594 - DNA, 446 bp, Homo sapiens
agagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggaagaaatttactttttggggatattcttatatatattatggacatcgctggctgaaattttagtatttttggttttaataaagactaacacaaacttaatgatt

SEQ ID NO: 49595 - DNA, 324 bp, Homo sapiens
  misc_feature 50, 54, 107, 234: n = A,T,C or G
acattttgactgcgttacttattaaggccgaatgactttgacacccccgnggantatttttatgatcacatcaaatttaaacaatgtccaaagtgtaactttaatgntatattttgtttcaaaccctctggctaagattattgagaaagatgttttttcctcctccctcaaatatgttatctcttcatatataaaaaaataagttattccatgcttttcaggaactgtaaaaantatttcaaaaagatatttgaaaaagttttctctattctggacacaaatgcttccatttatttcaaaagaagaagaagaaaaatggaatct

SEQ ID NO: 49596 - DNA, 426 bp, Homo sapiens
ggccaaacactctagatagtcaaataaattccccttttggtgattcagaccagtaatggggattcagtacagtaactgcctatcctcatcaatgcttgtttgtgatgatgaaatagctgacaaccgggactttacaaaaatagctcctgaaaaaaattaaatattttattgcaatatatgttcatattttttttaacttttatgaaatagcattgtgataggtgctttaagaaaaatatttttccagaagtggttatagtataaactaagggcagtttttacattgtgatgtgggggtggatggccatatttagttaggttattaagaaatcatgaagggtccctaacaagaaacttgcaaagctatttggcaggaagaaaacattaacttctagtttatttattttttttctcatgctatacgct

SEQ ID NO: 49597 - DNA, 378 bp, Homo sapiens
ttaagaaacttagaacccatggaaccgttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggcatgccgttatgtatgtaagcctgttgctgctgaaagatgtctgtgtgcctgtatcaacatgtgacttcatgtaaagtttctttgtgttcacagttctgagcaaatgcagtacaatccatagatagccagcagtggatgttactccaggaaaatgcaggattaaaattgccttgtgttttgg

SEQ ID NO: 49598 - DNA, 364 bp, Homo sapiens
  misc_feature 302: n = A,T,C or G
tggtgttagctccagcatcccctttgcttgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcaagctgctgtgctgatgtgggaacagctcttctcccagatgtaaataggaacaacctgcacaacctggatttttttaaaaatacaacactgagccattngctgcatttctttttatactaaatatgtgactgacaataaaaacaattttgactttaaaaaa

SEQ ID NO: 49599 - DNA, 486 bp, Homo sapiens
gaagatgaatgccagaggactcggagctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaaatttccagctcaaccaagataaaatgaatttttccacactgagaaacattcagggtctatttgctccgctaaaattacagatggaattcaaggcagtgcaagcaggttcagcgtcttccatttctttcaagctcaaatctttcactggatgttttgaggggtaatgatgagactattggatttgaggatattcttaatgatccatcacaaagcgaagcatgggagagccacacttgatggtggaatataaacttggtttactgtaatagtgggctgtcatggaaaccgaggctgcatcttggttataggcatcttggactg

SEQ ID NO: 49600 - DNA, 491 bp, Homo sapiens
  misc_feature 28, 442: n = A,T,C or G
tttggcccgagactgaccccaagaccgngcaggacctcacctcggtggtgcaggacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaagggtgctaataatttatactggaatctggcatttttccaagccaagagaagatcgaatggctttttgcagctaactactatgtgtagacagggttttatattataaagtatgcattcttatcacctagtatatagttaggttgtagagtgatttccccccagtttcttgaacatggtatcttcacatcttggaccttggcaggttgngctattcattattaaacactaaaactttggcgggtcttgcataaaaaaa

SEQ ID NO: 49601 - DNA, 332 bp, Homo sapiens
  misc_feature 171, 173: n = A,T,C or G
atagatattgttttatatccatttacggccccccttatgtcagtgatcagcttctcacaggaagggatcatattcacgttggtttgattaatggaagaaaatcagaaaggtaaggaatgaggaaaacaatttatgactgtgatttgtccaggaatcatcacagcgctccgntntgaattataggtactcagaaagtgagattcaggccaggcacagtggctcacgcctataataccagcactttgggagggcaagacaggatgattgcttgagcccaggagttcaagatcaatctgggcaacataatgagaccctgctctacaaaaaaaaaa

SEQ ID NO: 49602 - DNA, 199 bp, Homo sapiens
atagatgagtacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctaaaaaaa

SEQ ID NO: 49603 - DNA, 207 bp, Homo sapiens
ggctgtactaaaaaatatacaaaaaattagccgggcgggttggggggcacctgtagtcccagctactcgggtggctgaggcaggagaatggcgtgaacctgggaggcggagcttgcagtgagccaagatcgcgactctgcactgcagcctgggcgacagagcaagactctgctgaaaaaaaaagatgaacagacaaaaaaaaaaaaa

SEQ ID NO: 49604 - DNA, 220 bp, Homo sapiens
aaatacaattatattgtaaaattataactgggcaagcatttatgacatattaatatttgtcagaattaagtgactcaaagtgctatcgagaggtttttcaagtatctttgagtttcatggccaaagtgttaactaagttttactacaatgtttggtgtttgtgtggaaattatctgcctggtgtgtgcacacaagtcttacttggaataaatttactggt

SEQ ID NO: 49605 - DNA, 512 bp, Homo sapiens
  misc_feature 420: n = A,T,C or G
gaggagaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagacagtttatctatacccttcctatctgaggaggagaatagaaaagtagggtaaatatgtaaccgtaaaatatgtcattcaaggaccaccaaaactttaagtaccctatcattaaaaatctggttttaaaagtagctcaagtaagggatgctttgtgacccagggtttctgaagtcaagatagccattcttacctgccccttactctgacttattgggaaagggagactgcagtgggtgtttctgttgcagnggcaaaggtaacatgtcagaaaattcagagggttgcataccaataatcctttggaaactgggatggcttactgggtgctaagaatgaaaatg

SEQ ID NO: 49606 - DNA, 427 bp, Homo sapiens
cctagtaattcacaactgtagacacatgggcaaaattagtatttttaagaataaatacatttctatttttttggttgtttcaacattagctcttcaaattcattacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttggctatatctgtatttcatttgtttagaaagattcttttggggttgataatgtaatttgtatatttaaattttttatggacataattcaaaggaatgtataaattggccttttgtaaatggctttttaattgg

SEQ ID NO: 49607 - DNA, 372 bp, Homo sapiens
  misc_feature 38: n = A,T,C or G
aaaggaagggatcatgaaaatgttaaagaaaaagattncagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaggagtgcgatcaagaacccatgacagagatcgcagcagaagcaaggagtaccatagatacagagaacaggaatacaggagaagaggacggtcacgaagccgagagagaagaacaccaccag

SEQ ID NO: 49608 - DNA, 573 bp, Homo sapiens
gcccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgggaacttctggggttctaaagtattatgtattaacctgccatactggaatcagacataaatacttatttatgcctaaaaatgcctggtacttacaggtttgttcctggcagtaaagaaaaattcttcatttggggcaaaatttggaacaaagagggaaacatcttcatagg

SEQ ID NO: 49609 - DNA, 457 bp, Homo sapiens
aatgcatcgcctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacaggtcctgtgttcttcttggtttggacttaagcaccatatattaagagttgaattgcatatctgtttattgccttatgg

SEQ ID NO: 49610 - DNA, 143 bp, Homo sapiens
cgagtgatctaaaacgttagatagagtgtggccttgtgggttcctgttgctggagacttcctaggatggagccgccctaaaccgccgggcccggtgcccttgcgcgggagttggggtccaaataaagttcttgggatgtaaaa

SEQ ID NO: 49611 - DNA, 390 bp, Homo sapiens
  misc_feature 100, 346: n = A,T,C or G
gcacaaagaagcaatcatcaaataattctgaacacaaatttaatatttttttttctgaatgagaaacatgagggaaattgtggagttagcctcctgtggnaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaatagggcttggggnacaaaactttttatatcaaaaggctttgcacatttctatatgag

SEQ ID NO: 49612 - DNA, 397 bp, Homo sapiens
  misc_feature 109, 116: n = A,T,C or G
tgaacgtgctataggaccttctcaaacacacaccatcagaattcaatattcacctgccagactggcttatcaagacaaaggtgtccttcataatgaagttaaagtgagnatactgnggagaggacttccaaatgtggttacctcagctatatcactgcccaacatcagaaaacctgacggctatgattactatgccttttctaaagatcaatactataacattgatgtgcctggtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgcatgagt

SEQ ID NO: 49613 - DNA, 278 bp, Homo sapiens
cagaagtaaacacaagttttttggagaaatataccttcatcctagtactatagaagtctcccaaataatttagcaagaaggtagaaacatgagtgagaattaccagaaacaaaaggaagcagaaactgacccataaaggctaattactagagttacgtcatacagatttataaaatgactactgtcttgtttaaagaaaaatcagatggttatctgctatgatatgataaaataaaaccagtgtgttttaagaataatctaatagaactaaaaaaaaa

SEQ ID NO: 49614 - DNA, 368 bp, Homo sapiens
gggggatggaaccgcacagagccgcggccctttgcagctgcgattttcgccctacgttttcaacggaggtactatactggcaatggctggagaagattttgcaattgtggcttctgatactcgattgagtgaagggttttcaattcatacgcgggatagccccaaatgttacaaattaacagacaaaacaggcattggatgcagcggttttcatggagactgcttacgctgcaaagattattgaagcaagactaaagatgtataagcattccaataataaggccatgactacggggcaattgctgcaatgctggctacaatcctgaattcaagggcttctttcatactatgttaacaacatcatcggg

SEQ ID NO: 49615 - DNA, 529 bp, Homo sapiens
  misc_feature 17, 346, 437, 467, 504: n = A,T,C or G
gccctgcagcacctaangtaaagtgccttgcacagggtaaggtgctcatgacgtgtagaatgagtgagtaacttcctgcctcatcaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgcctgcgtttttatctgatattagagctgaggtcctaggaaaattttgaagtggggaagattatggagaaaatgaaatggaaatttggggcggnggtttgcagtataaggccctggggggtaatcatattttagttattacttggtaaaagggaacagacctctgtttctttaccaagcgctggntggccatttctccaattgatgactaccatnggtttagctcttctcatttgggaatcccctcaaaagntaaatgatctgggacttagagctaa

SEQ ID NO: 49616 - DNA, 396 bp, Homo sapiens
  misc_feature 36, 48: n = A,T,C or G
caccatatgtgataacaaaggatctttcttgaatgnccaagggtaagncagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatctaaaa

SEQ ID NO: 49617 - DNA, 315 bp, Homo sapiens
  misc_feature 239: n = A,T,C or G
tgctttttcttgccaagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagccgctggcttctcaaacggccgaagntgcctcttttaggaatctctttggaattgggagcaccgatgactctgagtttgagctattaaagtacttcttaccc

SEQ ID NO: 49618 - DNA, 553 bp, Homo sapiens
  misc_feature 434, 510: n = A,T,C or G
aaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgcgagatgatctgttactgcaacttcagcgaattgctctgctgcccaaaagacgttttctttggaccaaagatctctttcgtgattccttgcaacaatcaatgagaatcttcatgnattctggagaacaccattcctgatttcccacaaactgcctacatcagtataactgcatttctaggttctatatagngcaatagagcataagatctataaatcttactggctaagacaag

SEQ ID NO: 49619 - DNA, 533 bp, Homo sapiens
  misc_feature 23, 25, 71, 133, 264, 329: n = A,T,C or G
gcagcggctctaagaagcgcagngnaactcgaccggatccaacccagttagttacttcctgctagagttgnagcttccacctgcaccttctagccaccatggcaacctcatctgaagaagttttgctgattgnaaagaaagtgcgcaaaagaagcaggatggagctctgtacctcatggcaagaaagaattgcttggcacctgaagcaaagatagatttacaatcagccatatgtatgcagatattaaatgccagaaaattagnccagaagggaaaagctaaaattcaagcttcagctggtcctacatgcaggggacacaactaacttncatttttccaatgaaagcacagcagtgaaagagcgagatgcagtaaaagaccttcttcagcagctgctggccaaattcaagaggaaagcaaataaagactggaagagaagaacagaatgctgcaagaagatcctgtttggttcaagcttataaagaccttgtggggagcaagggacagggctgaggaatctgggccaatcggtt

SEQ ID NO: 49620 - DNA, 479 bp, Homo sapiens
  misc_feature 19, 50, 370, 378: n = A,T,C or G
tcagctctttgcaagattnctagaatcactcctagagaagtaaaaagaantgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggtcaaccttaattataggctcattgcaggactttactggttctccattttctagaactgctgtgctgctttgngatgacgngagatcaataagaagaacccagctagagacaatgatgctagtttgcatatgtttcctatgcaatagtggtttcccagtaatcaaagcagctttctatatgt

SEQ ID NO: 49621 - DNA, 459 bp, Homo sapiens
tcctacgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgctttcccatctgtctatctatctggctggcagggaaggaaagaacttgcatgttggtgaaggaagaagtggggtggaagaagtggggtgggaccgacagtgaaatctagagtaaaaccaagctggcccaaggtgtcctgcaggctg

SEQ ID NO: 49622 - DNA, 345 bp, Homo sapiens
aagtgaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatccttctcttacctgttatttatcaatttttcccagtatttttatacgaaaaaaattgtattgaaaacacttagtatgcagttgataagaggaatttggtataattatggtgggtgattattttttatactgtatgtgccaaagctttactactgtggaaagacaactgttttaataaaagatttacattccaaaa

SEQ ID NO: 49623 - DNA, 330 bp, Homo sapiens
  misc_feature 20, 137: n = A,T,C or G
gggtggccaaaaagagcgcngaatttttgctgcacatgcttaaaaacgcagagagtaatgctgaacttaagggtttagatgtagattctctggtcattgagcatatccaagtgaacaaagcacctaagatgcgccgncggacctacagagctcatggtcgggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaa

SEQ ID NO: 49624 - DNA, 317 bp, Homo sapiens
gtccagcagcagcagtagctatggcagtgtaaagctctaatgaatgccactacatggtggagcttgagaactcactgagctacccaaaagactagtttgtcattgcagtggctcctagacattgctttacgaggaaagaaaagaggaaagaggatgagcctagatacaaagggaaaggcttgggaaaaagaaactacatccatgatttttatagggcctcttttggtactattgttttgtaaataaaataggtagcaaatccagtcattcaaaattataaataaccactaaagggagaagcaatgctcactttagct

SEQ ID NO: 49625 - DNA, 502 bp, Homo sapiens
  misc_feature 23, 40, 452: n = A,T,C or G
tgccaaaaggaacaaaaggaganttatgaggatattcagngtgccacctacagaggaaactttgtcagagcccaacttttatgacacgataagcaagattcgtttaagacaacaactggaaatgtattccatttcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctggcattgttttgcctttttaaattacatctccaagtggctcaaaaggccttgacacagggaacctgcacatatccaggatatgtggtaaccagcgatggtgacttgaccttgccaagacctgngatccttcaggatacaatcaggggagaaataaaaacacatcttggggaag

SEQ ID NO: 49626 - DNA, 414 bp, Homo sapiens
  misc_feature 37, 39: n = A,T,C or G
ggcaaacatcgagtaattctttgaaactaaactctantntcccagagataccagaatctctgggacacagctaaagcagtggtaagagggaattttatagtgatgcccacatcaaaaagttaaaaggatctctaattcataacctaaggtcacacctggaaaaattagaaaaacaagagcaaaccaacgccaaagctagcagaagacaagaaataaccaaaatcagagctgaactgaaggaaattgagagatgaagagcaaaaaagataaatccaaattttaatttttttaaagaataaaaagattgataaactcttagctagactaataaagaaaaaaatagggaggacccaaatagacgcaattagaaaagacaacgaagacattaccactgaccccacaaaaaaaaaaaaa

SEQ ID NO: 49627 - DNA, 148 bp, Homo sapiens
  misc_feature 103: n = A,T,C or G
aatttaaatcagcgttagagtttgtgctgctgcaactgctgtgaaaatttctctgagtaattctgatttgggaatgatcccagaccaaccctgagattttgtnaacctgattaagtcaatatgaatgattaaaaagatgtgagagcaa

SEQ ID NO: 49628 - DNA, 325 bp, Homo sapiens
  misc_feature 23, 31: n = A,T,C or G
tcaaagaatccaaccctttcatnttacaggngaacaaactgggatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgcttctcggatactgaaaggcgagttttctgaactgcactgattttattgcagttgaaaaaaaaaaaaggct

SEQ ID NO: 49629 - DNA, 329 bp, Homo sapiens
  misc_feature 264, 268, 295: n = A,T,C or G
gatgaagggtgttttttttcttttaaatgaaagacctcctcatcttttcttcttacacagtgtctgagaacatttacattatagataagtagtacatggtggataacttctacttttaggaggactactctctgctgacagcctagactggcttctacactaagacaccatgaaggagtatgtgctcctattattcctggctttgtgctctgccagaccctactttagcccttcacacatcgcactgaagaatatgatgctgangganatggaagacacagatgatgatgatgangatgatgatgatgatgatgatgatgaggacaact

SEQ ID NO: 49630 - DNA, 379 bp, Homo sapiens
  misc_feature 277: n = A,T,C or G
gggtcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggnttttggccagtctaaatattgtaagagagagagaagaaaagtgtacggaatataattgtctctaagctaagaaatgtggatgtcaaataaaacatacgtcgg

SEQ ID NO: 49631 - DNA, 270 bp, Homo sapiens
  misc_feature 189: n = A,T,C or G
ttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgngcttcctgctgtatgtgagctgtaaaaatgttacgtgaagaaataaatgaaacttggccagttaaaaaataaaaaataaaa

SEQ ID NO: 49632 - DNA, 493 bp, Homo sapiens
  misc_feature 14, 50: n = A,T,C or G
ttcctccgcaaccntgtctgacaaacccgatatggctgagatcgagaaantcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagaggccatttttttttt

SEQ ID NO: 49633 - DNA, 369 bp, Homo sapiens
cctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcagggcaataaaaacaaaattaaaacccaaatcatcat

SEQ ID NO: 49634 - DNA, 612 bp, Homo sapiens
aggaaaaggtcccggagagctgagcagtcaagatgtgttgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacaggtggccaagaacaaggaccaggcacctatgaggattatgtcgaaggacttcggtgtttgacaaggaaggaaatgcaccgcatgggtgctgaaatccggcatgttcttgtcacactgggtgagaagatgacagaggaagaagtagagatgctgggggcaggcatgaggacagcaatgggttgtatcaactatgaagcgtttgtgaggcatatcctgcggggggacgggcccatgggcggagctcggcccgatgggctgaatggctgaggaccttcccagcttcccagagccgggcctttcctgggggaaatttggatttagccaaaggttccctaggcttttttggtttaa

SEQ ID NO: 49635 - DNA, 346 bp, Homo sapiens
  misc_feature 29, 36, 56, 66, 283, 326: n = A,T,C or G
ccgtaactgtctactactttgatataatntgtattnatcctgtatgctgagctggnaaaatacatngtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgtngcacatatttttgcctctgtgagtcatctgatgattgagcagnagcattgccttgggggtttt

SEQ ID NO: 49636 - DNA, 503 bp, Homo sapiens
  misc_feature 298, 328, 434: n = A,T,C or G
ggagaagttgaaactccagatgtgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagttattttcaagtgaggaaagagaaaaaattactcagacttgttcctggngaaggcattctctgttggatacttttgganggagaaattgactatagaactgcttaatttttgaggcatttaagacagcaatgaaaggaggtctccacaggacaccgaatcaaaaggagagaccagactctgcctnatacccagcctatttgaacaagctatctagtttctcctgcgacaccttggcaaaacatgcacaagggca

SEQ ID NO: 49637 - DNA, 238 bp, Homo sapiens
  misc_feature 37, 70, 111: n = A,T,C or G
atactacagaaatgagaatctcatcaataaattagtncaagcataagatgaaaacagaatattctgtggngccagtgcacactaccttcccacccatacacatccatgttnactgtaacaaactgaatattcacaataaagcttctgagtaacactttctgattactcatgataaactgacatggctaactgcaagaattaaatcttctatctgagagtaataatttatgatgactca

SEQ ID NO: 49638 - DNA, 171 bp, Homo sapiens
aacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatccaaaaaaaaaaaa

SEQ ID NO: 49639 - DNA, 253 bp, Homo sapiens
  misc_feature 37: n = A,T,C or G
gtactaaactggtagccaattgttcacttctaaattnaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggttaaaaaaaa

SEQ ID NO: 49640 - DNA, 137 bp, Homo sapiens
  misc_feature 36: n = A,T,C or G
tgtataaaaataaagagattttcctgagagaactgntttcaaatgcttctgatgctttagataagataaggctaatatcactgactgatgaaaatgctctttctggaaatgaggaactaacagtcaaaaaaaaaaaa

SEQ ID NO: 49641 - DNA, 445 bp, Homo sapiens
  misc_feature 75, 212, 267, 289, 351, 384, 401: n = A,T,C or G
cggagactctggaatatatttgaaaattgaaccagtaaatatacactttgttcacaatgttttacatgaaagganaaaatagtaacatgatagaaattcagaagtaacctgatgaaaatatcacagaatcgtagttttgtttttctgacttaagataacagttcaaactgaaccgtcctctctctctgaaatgaatactttctactttaagnagatggaagctttgctaactttaatagtctcgaagtttaccagggtcactttggncttatgttttagttttgggggnttggctgggaattataaactcagaattctataggcaacaaaaatattctttaaactttttgncagcttgacaatgctatgcctttgcatgggctnggggtcactgacatctngggctgaaaattctctgagattgaattggggaaacttgcgccat

SEQ ID NO: 49642 - DNA, 305 bp, Homo sapiens
  misc_feature 299, 300: n = A,T,C or G
gcccactagttacatgaaattgggcagggaggaatttatgttagcctacatacaagtctgaacataactgacgtcagcattgccatgggaagtcaatatattgctgggtgttgcaaatattgagtttagatgactcttcctgtaaaggatagaaacattgtttttaaaacttcaatttaggctgatgagaaaatactatagaaggaaggagaacatcttgaagatttaaaaaatgatctataagctctggaaggaaatttttagaaaaatgattgaggcaccagcaattagcctaagcnnaaaaa

SEQ ID NO: 49643 - DNA, 488 bp, Homo sapiens
  misc_feature 447, 449: n = A,T,C or G
gtcgcagactttcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcggcgtcttccatttctttcaagctcaaatctttcactggatgttttgaggggtaatgatgagactattggatttgaggatattcttaatgatccatcacaaagcgaagcatgggagagccacacttgatgggggaatataaacttgggttactgtaatagngngctggtcatggaaaccgagggctgcatcttggttaatag

SEQ ID NO: 49644 - DNA, 437 bp, Homo sapiens
aaagatgaaaaattataaccttgcataatatagcaaggactaacccctataccttctgcataatgaattaactagaaataactttgcaaggagagccaaagctaagacccccgaaaccagacgagctacctaagaacagctaaaagagcacacccgtctatgtagcaaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacccaa

SEQ ID NO: 49645 - DNA, 500 bp, Homo sapiens
  misc_feature 431, 467: n = A,T,C or G
tgaatttcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgttcttgggcaagcagaaaaattaaattgnacctatttggatatgtgagatgtttaaataaattgngaaaaaaatgaaataaagcatgttgggtttccc

SEQ ID NO: 49646 - DNA, 198 bp, Homo sapiens
  misc_feature 91, 125, 154: n = A,T,C or G
taataaaagcttaggattaattagaagaagcaatctagttaaatttcccatttgtattttattttcttgaatacttttttcatagttattngtttaaaaagatttaaaaatcattgcactttggncagaaaaataataaatatatcttataaangtttgattcccttccttgctatttttattcagtagatttttgtt

SEQ ID NO: 49647 - DNA, 577 bp, Homo sapiens
  misc_feature 36, 506, 542: n = A,T,C or G
atgaactttcccccagcctgcaccagtattgttttnaaacattgcccatgagtaggccctttgaagagttagcttcctcctcatctttgactataaaattgtttaatcaatggaatttgtaccagccttttaaaaagttttagtttttcctaagtgattttgctctcttccaatctaaacctgttgcttgtttggttcagagaactacaaactgtcaaagaaagggtggggatgataagaaatgctaatataaaaatgctaagtgaaaaaaagacttggccaggagaaataatttaaaatgcacatttgctttggatgcactgttgtctgttaaggctgatatatttgttatttaaggggctgaaagtgcaaagaggaaatggcagcatgcaattcatcctaatgtacaaaacgttatatgcactcaaatgtataatttctaatattttaaagttatatcgagttgacaaagttaagcattaatcaagatattcatttttcataangtaccattttcttaaatattattacaaaatttaagnctggctaatggaggagtttttttaaactgctacct

SEQ ID NO: 49648 - DNA, 649 bp, Homo sapiens
  misc_feature 37, 38, 41, 71, 517, 518, 562, 605: n = A,T,C or G
aaacagatgcagtgcatcatttacatcttcagaacannttntagagcgattaagaagcgaaaataaggatnttgaaaatctgagaagagaacgagaacatttggaaatggaactagaaaaggcagagatggaacgatctacctatgttacagaagtcagagagttgaaggcacagttaaatgaaacacttacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgtcatttgaggataaaaaaaggcattgtattatatnntgccaaattaaagccttatttatgttttcaccctttctacttgncaagaaacactgaacagagtttggcttttctaatccttggtanactactgatttaaagaaggaaaaaaaaagcccacctttgaggac

SEQ ID NO: 49649 - DNA, 607 bp, Homo sapiens
  misc_feature 346, 350, 421, 496, 555: n = A,T,C or G
tttctggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctggggncagntttcatagtatccatattttattactgtttattacttccatgaattttaaaatctgagggaaatgttttgnaaacatttattttttttaaagaaaagatgaaaggcagcctatttcatcacaagaccacacacatatacacgaatngacatcaaactcaatgctttatttgaaaattaagggggtttttatttctactggcaaangatggggcaaaaccttttactgggtggctgggaaacagccaggttttaaaaa

SEQ ID NO: 49650 - DNA, 536 bp, Homo sapiens
  misc_feature 36, 37: n = A,T,C or G
aaatggccaataaacatggaaaaatgctcagcatcnnttattatcaggtaaataaatgcaaaccaaaaccatgatgagataccaccttactccagcaaaagtggccataattaaaaaatcaaaaaataacagatgttggcatggatgtggtgaaaaggaaacacttttacactgctggtgggaatgtaaactagtacaaccactgtggaaaacagcgtggagattccttaaagaactaaaagtagaactaccatttgacccggcaatcccaatactgggtatctacctagagggaaataagtcattatacgaaaaagacacttgcacatgcatgtttatcgcagcacaatttgcaattgcaaaaataaagaaccagcctaaatgtccatcaaccaacaagtggataaagaaaaagtgatgtgtatgtatataccatggaatactactcagccataaaaaggaatgaaatagtggtatccacaacaacctggatggagtggggccgttattctaagtgaagtacccattattctaag

SEQ ID NO: 49651 - DNA, 201 bp, Homo sapiens
  misc_feature 69, 70: n = A,T,C or G
tgcagtttttcaggagcgcaagatagatttggaatattaataagctctagttcttaacaaccgacactnngtacaagatttagaaaaaagtttacaacataatctagtttacagaaaaatcttgtgctagaatactttttaaaaggtattttgaataccattaaaactgcttttttttttccagcaagtatccaaccaact

SEQ ID NO: 49652 - DNA, 398 bp, Homo sapiens
  misc_feature 72, 97: n = A,T,C or G
ctgaaagaatttttaaggagaggaaaacctagaaggtgggttccttaaaattttctttgttttcacagtctntggaaagtctttgtgtattccaagnataccaatattccagcttaaagattggtgctctagaaaacatgttaaattctggaggtgatcactcctatactccaatgatcttgacgtgcgagcaatagggagtaggtgagggaaaggatgagacttgaaattaggaagaaataactttattcttttcaatttgatttattaattaataaatataagtaaaatagttaaaataataagtaaaaataagttttaaagggaattttttcccattattaatactataagaataacatgaacatatggaatattgttgttttagaataaaaaaa

SEQ ID NO: 49653 - DNA, 111 bp, Homo sapiens
  misc_feature 39, 40: n = A,T,C or G
tcatatacaattactgacctatgctctaaaacatgaatnntttgttacagacccaagctgtccatttctgtgatgggttttgaataaagtattccctgtctgaaaaaaaaa

SEQ ID NO: 49654 - DNA, 208 bp, Homo sapiens
aggctgaaaattgctttcatttgcaacacatttagaaagtagctttatttggatattacagacaatctaaatatatcatcagtttttaaaagtgcctatgtgaagtgatttttaaaaagagcctatgtgaaggggtaatcttgcttgttcttgttactaatttctcatagattgtttttctgcatatataagaacgaaattatttatt

SEQ ID NO: 49655 - DNA, 487 bp, Homo sapiens
cctctgccaagaccaaaaggaaagaagaaattgggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcataggattctataaattcttacttgtctaagacaagtaaatctg

SEQ ID NO: 49656 - DNA, 356 bp, Homo sapiens
  misc_feature 83, 135: n = A,T,C or G
gccagagtcccttttatagagaagcttaaaaaatatttgttgaattaaatgtcttaggtagagacaaattgaattaaagtggntacgtaaatactcttaggtgaaatttgtgcaaattatgagtataaagagggngagctacagaactctccatgaccactcaagaatgggacccaaaggcaaatgataacttattcattcatcaagggataaacttgagttatcaaatggttaatagataaagatcccactctgccttggatttagccatcgcagtccctgtgtaaaaccccaccggctttcaggcatggaaaaaaatttcacaaaggccttgaaagaaggcatatgaagaccaa

SEQ ID NO: 49657 - DNA, 155 bp, Homo sapiens
  misc_feature 31: n = A,T,C or G
tgagactccccttagagatagagaaacagtnccaagaaatgtgctcaattgcaatgggccacatacctagatctccagatgtcatttcccctctcttattttaagttatgttaagattactaaaacaataaaagctcctaaaaaatcaaaaaaaa

SEQ ID NO: 49658 - DNA, 323 bp, Homo sapiens
  misc_feature 33, 36: n = A,T,C or G
tgcagacaaatgacttgaaagaagtggacaatnttnttgattccagacagcattggaaaagacatagaaaaggcttgcaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaaaa

SEQ ID NO: 49659 - DNA, 629 bp, Homo sapiens
  misc_feature 476, 564, 589: n = A,T,C or G
ttaacagagaacaaaaactcttactaaatacccggataaatttgtgcctgagtttactaagtagctacctgtaaggcagtgtttatcgttttgcgatggggcgtttctgacaggaacaattccatttggagaatagactattgttttgacttgagctgagcaattacttgggcaaatttatttataaaatacttaacagctgccttatttgggcttccaacttctaagatgagagcagtaataaccacaaatggagaaaacagggggtagctacataagaactacctgacagatttctcatggataccctcaagatggtttcccaggggaattctgatgtcactgggtttgggaaccacagaactaagtgatctcctgattctttttgctataacaatttctgattggcttggctttgctaggcaaataaagagaatacagattaaataacagactaaattaacttacccatttgnaaatttatatatacatatatataaatacattacttttattataaataatttaaggccacaagaagtgcaacaatagaaaaggttgggnatcccttcatccagctttcccaaangataggatctttcataccaggggatattttcaaaaggagg

SEQ ID NO: 49660 - DNA, 182 bp, Homo sapiens
agagactgatgaaaaggaaagaggtaagtactgagaaagagaaagtcagaatcctggaatcttaggctggcaggaactttgaagatatctagtttaaggtctttgatgcccattgcaggattcaaaatattaagacgatgctgttatgagatttgagatatgtttgttaggaaaaaaaaaaa

SEQ ID NO: 49661 - DNA, 413 bp, Homo sapiens
  misc_feature 248, 280, 336, 392: n = A,T,C or G
actaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggngacttaaacagcttaaagtttagtttaaaagntggagggtgattaaaataatttgaaggcgatcttttaaaaagagattaaccgaggngattaaaagaccttgaaatccatgacgcagggagaattgcgcatttaaagcctagntaacgcatttactaaacgcag

SEQ ID NO: 49662 - DNA, 232 bp, Homo sapiens
  misc_feature 125, 131: n = A,T,C or G
cccagcccttttttctgttggtttagcacaaatacttccctcctccggcacctccaaacctacccacagtcagtgtacttgttttatatatatttaatcttattcaatggaaaccatgcttttgncgtttnatactttgctaggtagactttattacccccccactatgccctcatttttttaaaaaaggaaaaaaaaaagaaactgggttccagtcttaattcattttccg

SEQ ID NO: 49663 - DNA, 329 bp, Homo sapiens
tgtaataaaaatgcacaacataaaatgtttattatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggcca

SEQ ID NO: 49664 - DNA, 424 bp, Homo sapiens
  misc_feature 31, 266, 268, 324, 407: n = A,T,C or G
ccactctgcgtgtgtgtgctctcgcgcactntgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagatttngnacatctcagtccataaagcaaagcttgttgatagtgtagttttctaaacgctgcanatttgcagcctttaccactacaaagaagttggatgagggatttttttttctttgcaaaatagtcctgttctgtagaaattcanttttagattaactggga

SEQ ID NO: 49665 - DNA, 539 bp, Homo sapiens
aaggccattcgatttctttcccttcagaagtgtcattcagcaagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcaggaccagagagcatttaggataatagatgacctaactgaaggaatccttgtatatgaaaggagttattttaggaaaagcaataaaaatattttattcatcatagctctctgctttgggctctgcaggccaccagatacacatgaggcccccacttctcaagctgggaaggcaagagccttccttcagcctttctggttatgttacacctagctgaatgtttacaagggctggatccatcagccctcaggccaggttgggccaagcagaaagagagaaacacttctgctgcaccttgaatgactcaggaatagcttccct

SEQ ID NO: 49666 - DNA, 346 bp, Homo sapiens
  misc_feature 31, 105: n = A,T,C or G
gattaaaatgaaggtgacttaaacagctttnagtttagtttaaaagttgtaggtgattaaaataatttgaaggcgatcttttaaaaagagattaaaccgaagggnattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtaccgggaaggcgaagaaaagaatagagaagatagggaaattagaagataaaaacatacttttaaaaaaaaaaaaaa

SEQ ID NO: 49667 - DNA, 362 bp, Homo sapiens
  misc_feature 51, 94, 108, 208, 228: n = A,T,C or G
ggaatcaattgcccgcaacacaggagccaaaaacctgtatatcatctccgngaaggggatcaagggacggctgaacagacttcccgctgctggngtgggtgacatggngatggccacagtcaagaaaggcaaaccagagctcagaaaaaaggtacatccagcaggaggcattcgacaacgaaagtcataccgtagaaaagatggaggnttctttattttgaagataangcaggagtcataagtgaacaataaaggcgagatgaaaggtctgccattacaggaccagtagcaaaggagtgtgcagacttgtggccccgggattgcatccaatgctgcagcattgcatgatctccagatatttg

SEQ ID NO: 49668 - DNA, 507 bp, Homo sapiens
  misc_feature 30, 98: n = A,T,C or G
ggagaaacagaagaaactctgaagaaattnttacaagaagacacacccgtgaggaagttgcaagccaacaaaaaagttcaaggatctagaagacgatnaagggaaggtcgttctcagtgaaaatccaaaaaaccagaaaaaaatgtttatacaaccctaagtcaataacctgaccttagaaaattgtgagagccaggtggacttcaggaactgaaacatcggcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagtctggctaactttggaatccattagagaaaaatccttgcaccagattcatgacaattcaaatcggaagagttgtgaactggtatcccattgaaaagccgggccttgtatgtatgtatgggatacataaaa

SEQ ID NO: 49669 - DNA, 251 bp, Homo sapiens
gaaacttctggaggacaaactgggggagctgccaagctggatcttgatgcgggacttcagtcctagtggcattttcggagcgtttcaaagagagcacgagcggctccgcaaataccactgaagaggacacactctgcacccccccaccccacgaccttggccgagcccctccgtgaggaacacaatctcaatcgttgctgaatcctttcatatcctaataggaattaacctccaaataaaacatgactggt

SEQ ID NO: 49670 - DNA, 403 bp, Homo sapiens
aaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacag

SEQ ID NO: 49671 - DNA, 242 bp, Homo sapiens
tagagctagtagtaagaactatgtttttaaaatgtgtagcttaaactattttgggtataaagtatttccatgtgaattagtaacaattttatttctagaaaaattagaacatgtattgactttaaagcttttgaatattcatgaaacatttcttaagaacctatcattgtttaatacattgagttgcttgctatattgtggtagttttaaaacttggtaaaaaaaaaaaaaaaaaaaaaaaa

SEQ ID NO: 49672 - DNA, 271 bp, Homo sapiens
ctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgtagacatgaatacatttcccaccttcaaatttgaagatcccaaatttgaagtcatcgaaaaaccccag

SEQ ID NO: 49673 - DNA, 102 bp, Homo sapiens
aatcagggttcgattccggagagggagcctgagaaacggctaccacatccaaggaaggcagcaggcgcgcaaattacccactcccgacccggggaggtagtg

SEQ ID NO: 49674 - DNA, 317 bp, Homo sapiens
caccttcccacattcgaaggaagattatgtcttcccctctttccaaagagctgagacagaagtacaacgtgcgatccatgcccatccgaaaggatgatgaagttcaggttgtaccgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcg

SEQ ID NO: 49675 - DNA, 305 bp, Homo sapiens
gctaagcgccatcgtaaggtgctccgggataacatccagggcattacaaaaccggctattcgccgtttggctcggcgcggtggcgcaagcgcatttccggtcctatctatgaggagactcgaggtgtgcttaaggttttcttagagaacgttattcgagacgccgcacctatacggagcacgccaagcgcaaaactgtcacagccatggatgtagtatatgccctgaaacgtcaggggcgcactctgtatggcttcggcggctgaatctaagaatacgcggtctcctgagaacttcaaaaaaaaa

SEQ ID NO: 49676 - DNA, 324 bp, Homo sapiens
ggaaaagaaaccaacagggattgccccagtaacggcgagtgaagcggcaacagctcaaatttgaaatctggcccctagggtccgagttgtaatttgcagaggatgcttttgacaaggtgccttccgagttccctggaacgggacgccatagagggtgagagccccgtctggtcggataccgcgtctctgtaaagctccttcgacgagtcgagtagtttgtgaatgctgctcaaatggggaggtatatgtcttctaaagctaaatattggccagagaccgatagcgcacaagtagagtgatcgaaagatgaaaagcactttgaaa

SEQ ID NO: 49677 - DNA, 329 bp, Homo sapiens
ataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataagggttatgg

SEQ ID NO: 49678 - DNA, 302 bp, Homo sapiens
gaggaagaggatcctgcggaggaggattgtcctgaattggttcccattgagacgacgcaaagcgaggaggaggaaaagtctgcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgt

SEQ ID NO: 49679 - DNA, 305 bp, Homo sapiens
cgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatgggtataagatggagacttcatagcatccagaagaagtgttgaagtaacctaaacttgacctgcttaatacattctagggcagagaacccaggatgggacactaaaaaaatg

SEQ ID NO: 49680 - DNA, 199 bp, Homo sapiens
ccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaa

SEQ ID NO: 49681 - DNA, 142 bp, Homo sapiens
gcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtt

SEQ ID NO: 49682 - DNA, 323 bp, Homo sapiens
ctcagtccatttgcggaggaacattggtgttacagcagtggcatttaataaggaacttgatcctatacagaaactctttgtggacaagattagagaatacaaatctaagcgacagacatctggaggacctgttgatgctaggtcaagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttg

SEQ ID NO: 49683 - DNA, 330 bp, Homo sapiens
tgatctgcttcgaagtattcaataccgctcaggattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacg

SEQ ID NO: 49684 - DNA, 304 bp, Homo sapiens
caaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagtcactgtgtgtcagaacaactttctaacaaacatttattaatccagcctctg

SEQ ID NO: 49685 - DNA, 314 bp, Homo sapiens
acaagaagattatgacagattacgccccctatcctatccgcaaacagatgtgttcttaatttgcttttcccttgtgagtcctgcatcatttgaaaatgtcccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggc

SEQ ID NO: 49686 - DNA, 307 bp, Homo sapiens
gaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccgctatgcccctgtattggattgccacacggctcacattgcatgcaagtttgctgagctgaaggaaaagattgatcgccgtctggtaaaaagctggaagatggccctaaattcttgaag

SEQ ID NO: 49687 - DNA, 260 bp, Homo sapiens
cttaacaagctagaaaattcagctcctttctgtcctgtagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaccaaaaaaaaaaaaaaaaaaaaaaaaaaaaaaaaaaaaaaaaaaaaaaaaaaaaaaaaaaaa

SEQ ID NO: 49688 - DNA, 311 bp, Homo sapiens
gacgctactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaaaaaaaa

SEQ ID NO: 49689 - DNA, 323 bp, Homo sapiens
ggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctccattcttaaaaaaaaaaaa

SEQ ID NO: 49690 - DNA, 349 bp, Homo sapiens
ggaaatgcctccgctgaaggccccgaggcgaaggtaccgaaagcacagtaatcactggtgtcgatattgtcatgaaccatcacctgcaggaaacaaggttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatgg

SEQ ID NO: 49691 - DNA, 219 bp, Homo sapiens
ctggtcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttacctaaaaaaaaaaaa

SEQ ID NO: 49692 - DNA, 314 bp, Homo sapiens
taaaataacattcctctcacttgtaccccactaaaagtattagtctacacattacattgaagttaaacacaaaattatcagtgttttagaaacatgagccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaaga

SEQ ID NO: 49693 - DNA, 281 bp, Homo sapiens
  misc_feature 134: n = A,T,C or G
aaacctaagcagctggaaggaaccatggccaactgtgagcgtaccttcattgcgatcaaaccagatggggtccagcggggtcttgtgggagagattatcaagcgttttgagcagaaaggattccgccttgttgntctgaaattcatgcaagcttccgaagatcttctcaaggaacactacgttgacctgaaggaccgtccattcgttgccggcctggtgaaatacatgcactcagggccggtagttgccatggtctgggaggggctgaatgtggtgaagac

SEQ ID NO: 49694 - DNA, 279 bp, Homo sapiens
ataacaatgtccaaattaatctacaagtccaatgcatttccatttaatatcccttccctcacttttttggggaatggaacctaaaatttatatttgcaaacagatatccataaagagtcaaaatattcctgaatagggagtcgttggtgggtagggaacaggagagatagagttcctgctatggtaattaagttggaatagtaagggcacatgtataaaactcagacatggcattacaaatcaatggggttagggagactttggctctacaaaaaaaaa

SEQ ID NO: 49695 - DNA, 317 bp, Homo sapiens
tgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaaataaaaaattctatgctatattgttgatcaagtgtaaatgtgaccttgtacagttactaaaattactgatattttcactacattgagacagt

SEQ ID NO: 49696 - DNA, 134 bp, Homo sapiens
tgatacaatattgtgcatgctagtgttgtatttctatacagtagcttgaaattgattaacttatactgtaggtgttatgtattcctatgacaaaaaaaattaagtcttcaaattttttaaaggttttttttttt

SEQ ID NO: 49697 - DNA, 375 bp, Homo sapiens
caaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgttttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttgctgt

SEQ ID NO: 49698 - DNA, 190 bp, Homo sapiens
gacgtgccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagg

SEQ ID NO: 49699 - DNA, 346 bp, Homo sapiens
gcatttgtaaatacagtagctataaaattttccatacttctaatggcagaatagaggaggccatattaaataatactgatgaaaggcaggacactgcattgtaaataggattttctaggctcggtaggcagaaagaattatatttctttgaaggaaataactttttatcatggtaattttgaaggatgattcctatgatgtgttcaccaggggaatgtggcttttaaagaaaatcttctattgggtgtaactgttcatatcttcttacttttctgtgttgacttcattattcccatggtattggccttttaaactatgtgcctctgagtctttcaatttataaatt

SEQ ID NO: 49700 - DNA, 386 bp, Homo sapiens
aataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttg

SEQ ID NO: 49701 - DNA, 370 bp, Homo sapiens
ccttcatttgtacttgaagtagattgcaaagtggttcatgaattcattggtggctacatatttctctcaacacgtgcaaaagaccaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattg

SEQ ID NO: 49702 - DNA, 189 bp, Homo sapiens
cacacagccaggattaaaagccaggacacccagcccttcaccttgtattctttctactgcctttgccgaccacagtgtaggaggcagaaccttaatatgcactaattctattctaaaacaacaaatggtttcattttctctggggcaataaatatctaacagaagtcaaaaaaaaaaaaaaaaaaaaaa

SEQ ID NO: 49703 - DNA, 338 bp, Homo sapiens
ttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctgcagttagccaagaggcggataagtgccccaccttagaacagtatgccatgagagcgtttgccgacgcactggaggtcatccccatggccctctctgaaaacagtggcatgaatcccatccagactatgaccgaag

SEQ ID NO: 49704 - DNA, 325 bp, Homo sapiens
gcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgt

SEQ ID NO: 49705 - DNA, 304 bp, Homo sapiens
ctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttgcacctggaagtaggtggcagatgttaacgcccttcctcccttgcattgcgccccctgtgcctacctctagcattgtaacgaccacatagtattgaaatggccagtttacttgtctgccttcctttccaagaccgt

SEQ ID NO: 49706 - DNA, 190 bp, Homo sapiens
tgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaaaaaaaaaaaaaa

SEQ ID NO: 49707 - DNA, 293 bp, Homo sapiens
gccaaaaatgaggctaagtgcatttactctcttcctggcattgattggggtaccagtggtcagtactatgattatgattttcccctatcaatttatgggcaatcatcaccaaactgtgcaccagaatgtaactgccctgaaagctacccaagtgccatgtactgtgatgagctgaaattgaaaagtgtaccaaattatcttgatacattcaaatttgctgggtaaaaaataggtggtagatattgaggccaagaatattgcaaaatacatgaagcttcatgcacttaaagaag

SEQ ID NO: 49708 - DNA, 320 bp, Homo sapiens
cacatatacactcatatcaaggcacaatcatataaatgtatgtatagttataaagagaaagagaggtaaaattggagcgatattttatatatttatattgtttccttatgctttctttttatttagcatcttatccagaatattctcccattttatataaattttactagggttactgtatctctttattatttccaagtgttctatatgttaaattgtcgaaaaatatacaaagaataaaagcacagcaccaaaggtattcatgtgggatcaccagatataacctatagtttagaatactattaacagagttttttttt

SEQ ID NO: 49709 - DNA, 353 bp, Homo sapiens
gtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactgg

SEQ ID NO: 49710 - DNA, 358 bp, Homo sapiens
gatccctgacctaacctgtctcttccttttcctcaacctcaggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctgcaagcagctggaagatggacgtactttgtctgactacaatattcaaaaggagtctactcttcatcttgtgttgaggcttcgtggtggtgctaagaaaaggaagaagaagtcttacaccactcccaagaagaataagcacaagagaaagaaggttaagctg

SEQ ID NO: 49711 - DNA, 214 bp, Homo sapiens
tcaaagaagtggggcttcaccaagttcaatgctgatgaatttgaagacatggtggttgaaaagcggctcatcccagatggctgtggggtcaagtacatccccagtcgtggccctctggacaagtggcgggccctgcactcatgagggcttccaatgtgctgcccccctcttaatactcaccaataaattctacttcctgccacctaaaaaaaaa

SEQ ID NO: 49712 - DNA, 344 bp, Homo sapiens
tggaaatctattcaattccaagaaagaatacttatcagcaatagtttagctagcactatattcaatatgaaagattaggaaattttcacagcatgtatacagtcagaatttaacactttcaaagatttcctttgtctactcccaaagtaaatttctgattaaattttagattaaaaaatttaagcaatgtattcaatattctactccctagtaatctaaatagcgcacagcattctttcatgttaatctattcagaggtgtggcacccaggaaacagtggccacatggtgtagggactgagtcataaagaacctgagggggttgtatttccctaaaaataaagt

SEQ ID NO: 49713 - DNA, 140 bp, Homo sapiens
gaaagactaatttaaagtaaaaacaagcaaagattaaaccttgtaccttttgcataatgaattaactagaaaatccttaacaaaaagaatttaagctaagaaccccgaaaccaaaaaaaaaaaaaaaaaaaaaaaaaaaa

SEQ ID NO: 49714 - DNA, 263 bp, Homo sapiens
atctgtgtgaaatgatttagtattataaatgttttgtgataaagtttatggtaaagattgattatagttacctcatttttatcttaaatggagtttaagtaaagtttgctttgccttgatagaattgtaacatcatgctccaagaaatataattccaataatttactataaaaagtaaattttaaaactttatgttaaattaacatttataaattcttttaaagttaattaaatctgaagtgcaccaagtattagctaactgg

SEQ ID NO: 49715 - DNA, 144 bp, Homo sapiens
aaagtggttggttgcatgttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaa

SEQ ID NO: 49716 - DNA, 375 bp, Homo sapiens
cccaaaacacattgaccagcatactccaaactgtttctgatgtgttccatgagaaaaggattgtttgctcaaaaagcttggaaaatactacacactccctttctccttctggagatcaacccacattagagtgcctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattct

SEQ ID NO: 49717 - DNA, 346 bp, Homo sapiens
ggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatg

SEQ ID NO: 49718 - DNA, 313 bp, Homo sapiens
acagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaag

SEQ ID NO: 49719 - DNA, 311 bp, Homo sapiens
aaaaaccttaattataacaacataatgaagcaataaaaatattttattgattagaaatacaatatttaggagtctatgtatctttattctattattcaaatactacaaactcttcagcaggacacctagtcatgtgtaataataattatattcaatctttagtattttgcctacttccaattatatagtgtaattttccagtttttaaaaaattttgtcattatgaagatacatctgcaaggagggaagaaagagcatatttaagagtttgctagcttgatttttataactttaaaatatttaaacctgtg

SEQ ID NO: 49720 - DNA, 288 bp, Homo sapiens
cctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagcaatgaagttgctattttgagtttagcattgatattgtgaaaataagtgcaatttggatttcatgtttcttaatattcattcttgtttcacaaatgaatgattaaggaattatgcatcataaaggaacctaagtgag

SEQ ID NO: 49721 - DNA, 318 bp, Homo sapiens
aaacagattaggaaacagaggaaatggaatagtgctgcctttatcttctttccagcaatggaaataaccagttgctcctttataatatgtaaactcttatctttctggcaggtaaaagacttcttagagatggttactattttatatgagaaaataggttgatttgaggagagtgataattgaggagggcatagtggatgcagacatggagatgaaagaaaatattttgaagaaaaatttttttctttttttttccccaaagtgagtagcatatttcacagtgtcattgtatgtatgattactcttaacattcttttt

SEQ ID NO: 49722 - DNA, 376 bp, Homo sapiens
gaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatat

SEQ ID NO: 49723 - DNA, 120 bp, Homo sapiens
cacaaagccatcttccttactttactcctaaaccacctcaagatagtgcggatatcaaagctggatattgtgtaaaacaaggagcagtgatgaaaaactggaagagaagatattttcaat

SEQ ID NO: 49724 - DNA, 165 bp, Homo sapiens
  misc_feature 7, 8, 11, 13, 21, 30: n = A,T,C or G
gcggggnnggngncgtcctcngatacccgnattttggggaactacccataagttactaaccttcattatacagcagagctaaaaagtggtgggatatttggggcttaatgaaaattgtatcatttaattccataaatattaaaatatttgggtaccttttaagct

SEQ ID NO: 49725 - DNA, 148 bp, Homo sapiens
gaagaatttgctgcctcttaagagctcgctgacttgtttgctggtgaaattttttgcacatctgactatcatggaagatacaataaaactacaccatgaggaaaactaaaggtctttatttaaaatctggcattggattaacatgtaa

SEQ ID NO: 49726 - DNA, 364 bp, Homo sapiens
  misc_feature 17, 189: n = A,T,C or G
ccaagacattgctaganggctataattaagtttgagaatatgtgaaatgcaattttctttttgctttgggtttttctacatttttctttttgctgtgttccggaccctcttgctttaaaatttgtaagttatcttgaatgtgttatggaaagtaaacttaatgaaatagatgagaaagttgagcagtgnatttttgaatttaatctgtcatgcatgtaaaatgttacacctaggcagggtgtggttggcattcctgtaatctcagcactttggaaggcagaggcagtagggatcacttgaggccaggagtcaagatcatcctggtcaacctagtgagaccccatctgtattttaaaaaagaaaa

SEQ ID NO: 49727 - DNA, 198 bp, Homo sapiens
  misc_feature 31, 65, 89: n = A,T,C or G
gcaagaccctaccttacaaacaataaatttnaattagccaggcatggtggtgtacaagtagctancgcatgtgatcctagctacttggngggagaattgattcagcctgggaggttgaggctgcagtgagctatgatcatagcactgcactccggcctgtgtgacagagcgagatcctgtctcagaaaaaaaaaaaaa

SEQ ID NO: 49728 - DNA, 477 bp, Homo sapiens
  misc_feature 27, 54, 56, 303, 342: n = A,T,C or G
caacagcatatggtcgtactttacttncttacagatttaatttcttttgtatgngnaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgcttcataagatttgggttgatgtattttactattagtctacaagaagtagtgtggtgtaattntaggaggataatggtcacctctgcgtaaactgcaagtcntaagcaggcatctggaatagagcttgacaaataattagtgtacttttttcttagttcctcctggacaacactgtaaatataaagcctaaagatgaagtggcttcagggagataaattcagctaataattctatat

SEQ ID NO: 49729 - DNA, 154 bp, Homo sapiens
tgtagcagctccttattgctggagaaggagagaagtgcccaagatcctttcaggatatttggttttttgggcgcgacacaaatcgaggtgagggaagagagaggaaaatcccctgaatccctgcaggattaatttattcaaaaaaaaaaaaaaa

SEQ ID NO: 49730 - DNA, 220 bp, Homo sapiens
  misc_feature 32, 33: n = A,T,C or G
tggacagaggttgttaaaaacaacttgaatcnngtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgccttctga

SEQ ID NO: 49731 - DNA, 392 bp, Homo sapiens
  misc_feature 35, 365: n = A,T,C or G
tttaagaaaaagggccgttctgccatcaacgaagngggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgggatgagaactaatcgctgatcgncaagatcaaataaagttataaaattgc

SEQ ID NO: 49732 - DNA, 466 bp, Homo sapiens
  misc_feature 62, 115, 147, 424: n = A,T,C or G
ataaaagctagatactggaaacctaacttcaatgtggatgttttacccacatgacttattangcataaagccaaatttccagtttaagtaattgcctacaataaaaagaaatttngcctgccattttcagaatcatcttttgaagcnttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagcaaatgccaaacactagctctgtattaatccccatcattactggtaaagcctcatttgaatgtgtgaattcaatacaggctatgtaaaatttttactaatgncattattttgaaaaaataaatttaaaaatcattcaaaactta

SEQ ID NO: 49733 - DNA, 378 bp, Homo sapiens
  misc_feature 18, 356: n = A,T,C or G
ggaaatgggatgcttgtntgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcntcatgatggtatgaggatggtg

SEQ ID NO: 49734 - DNA, 267 bp, Homo sapiens
  misc_feature 17: n = A,T,C or G
aacaagcatgatcttgntactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataggaggaatttggtataattatggtgggtgattattttttatactgtatgtgccaaagctttactactgtggaaagacaactgttttaataaaaaa

SEQ ID NO: 49735 - DNA, 501 bp, Homo sapiens
  misc_feature 62, 389, 407: n = A,T,C or G
acatgtgtggtcttgctggccaaatagttttgcatttatattagacatgaacatttattatnggcataaagaaaggaagttgaaatagcagctctctgagatcactctgaacatggggagacttgcttctaacgaaccttctgcaaatgcatctcacatatggggacaaaagtgctaagagaactaagcaacaatgtgggagttcatgttctgccctcacaagctaagtcctgtctctctctggatggcatcttctacagaaaaatatggatattccaatactgaattttatatctaattatgaggatgtagtgaaaaaagtgatttgatctttctatggatatataacatatatacagtcataccacatatataactatgtatacagnaaatgtatatactcttgnaaccacaggtacagccaccggaagctacctttgcccttctcagcaaattcttcccatctccatcagagtagctactcttttgcttccagcccat

SEQ ID NO: 49736 - DNA, 357 bp, Homo sapiens
  misc_feature 33: n = A,T,C or G
aatcagcatgattcttcagaggctcttcagggnctcctctgtcattcggtcagccgctcagtccatttgcggaggaacattggtgttacagcagtggcatttaataaggaacttgatcctatacagaaactctttgtggacaagattagagaatacaaatctaagcgacagacatctggaggacctgttgatgctagttcaagagtatcagcaagagctggagagggagctttttaagctcaagcaaatgtttggtaatgcagacatgaatacatttcccaccttcaaatttgaagatcccaaatttgaagcatcgaaaaaccccaggcctgaagaaataaagtaaaattaatctgg

SEQ ID NO: 49737 - DNA, 439 bp, Homo sapiens
  misc_feature 341, 356, 408: n = A,T,C or G
cacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggtcagtggaaatgtaaagaaggccctgaagctgatggggtcaaatgaaggtgaattcaaggctgaaggaaatagcaaattcacctacacagttctgggaggatggttgcacgaaacacactggggaatgggagcaaaacaagtcttttgaatatcgacacgcaaggctgngagactacctattgnagatattgcaccctatgacattgggggcctgacaagaatttgggggggacgntggcccttgtttgctttttataaccaaacct

SEQ ID NO: 49738 - DNA, 454 bp, Homo sapiens
taaaaaaaatattgggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaaggagcaactttcagccagaggcatggatgcttctctgtctcatcagtccttagtagcactatcagagaaactggcaagattaaagcaacagactatacctttgaagaaaaaattggagtctatttagacttaatgccgaatccgtctcttgctcaagtgaaaattgaagaagcaaagcgggactagatagcattgaagctgacttacaagaagagtagacatgatggaactggggcaaaagccaaataaacatcctttttccctacaaagtaaattgaataggactttacagg

SEQ ID NO: 49739 - DNA, 188 bp, Homo sapiens
  misc_feature 16, 60: n = A,T,C or G
tgttgtgtcttgtgancaagtcgctactgtgtccattattggaatggaattatcactacngtatcatgagtgggtattttgattctatggttccctcagtatcacatcttgacttgtaatcaattatgaatatttcttgatatttaatgtataggacatttatttatactcaataaatatttttcgga

SEQ ID NO: 49740 - DNA, 309 bp, Homo sapiens
ggtgaccaagatgaagatgcagaggggcattgtcatccgccgagactatctgcactacatccgcaagtacaaccgcttcgagaagcgccacaagaacatgtctgtacacctgtccccctgcttcagggacgtccagatcggtgacgtcgtcacagtgggcgagtgccggcctctgagcaagacagtgcgcttcaacgtgctcaaggtcaccaaggctgccggcaccaagaagcagttccagaagttctgaggctggacatcggccgctccccacaatgaaataaagttattttctcaaaaaaaaaaaaa

SEQ ID NO: 49741 - DNA, 239 bp, Homo sapiens
  misc_feature 34, 71: n = A,T,C or G
ttgttaataatgaagccatatgtttatgtctggntttaaaaattttaaacaatcatttactatgtcatttntctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgcg

SEQ ID NO: 49742 - DNA, 469 bp, Homo sapiens
  misc_feature 32, 33, 353, 383: n = A,T,C or G
ggcttcttcaaaattgagaatgatgaaaattnncaaaattatcagttgatgccataattatctctaagagatgttgtaataggaaattcatggttttcctttattttcctgtttctgaacacaaaattcaaaagaaaactctttcttccttgtcactgagactcttggtcagtgtaggctgtgaacttgtactttgtgaagagaagagtaccgtgaggaagcttgaaaatactgtaggtttttgttggcatcttcttctggatggtattcatgtactctgcacgccactgaaaatatgctctgtttttcataaaatatgctcattcttttatactgagcactcggaaattggntttcccaaaaccatcttagtggagaatggnctgcttttatcagttatgtgaagaagtaaattccaggctcctcagctgcaggatggctccttggtcacaggctgctgctcttgcct

SEQ ID NO: 49743 - DNA, 430 bp, Homo sapiens
  misc_feature 40, 367: n = A,T,C or G
cttacccaggggggtaaggcagcctctagctacttggagntgctgtaatagatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggactcacattttaaaaagaaataaaatttaaaataataataataataataataataataataaacctttgaccagggtcttccaagtagtttggatcaaagaatttataggtgtttcaaaacacagnccggagtgtaaaggattggaaagccccatggccttgcctgtgtgtatgaaggggaaatctggg

SEQ ID NO: 49744 - DNA, 319 bp, Homo sapiens
  misc_feature 23, 57, 145: n = A,T,C or G
acttccatgaattttaaaatctnttggaaatgttttgtaaacatttattttttttanggaaaagatgaaaggcaggcctatttcatcacaagaacacacacatatacacgaatagacatcaaactcaatgctttatttgtaaatntagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggg

SEQ ID NO: 49745 - DNA, 488 bp, Homo sapiens
  misc_feature 336, 360: n = A,T,C or G
tttaaagctgtccctgaagtgacagcggagagggccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtgggncaatttaatcggttaccttttggnggggagtttcatagccagcagcagtgccaatacaggactaattgtcagcctagaaaaggacttgctccattggttggaagaactgagacaagttggggaagtttctttaatctgacagggggttcagg

SEQ ID NO: 49746 - DNA, 541 bp, Homo sapiens
  misc_feature 453: n = A,T,C or G
aagcagcgagtcttgaagctcttgtttggtgcttttttatccatttccatcggtccttacagccgctcgggagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtaagatgtggatgactgcaggatgttgcttcagagtgtgaagtcaaatgcatgccaacattccagttttttaagaagggacaaaaggtgggtgaattttctggagccaataaggaaaagtttgaagccaccattaatgaattagtctaatcatgttttctgaaaacataaccagccattggctatttaaaacttgnaattttttaatttacaaaaatataaaatatgaagacataaacccagttgccatctgcgtgacaataaaacattaatgctaacactttt

SEQ ID NO: 49747 - DNA, 369 bp, Homo sapiens
  misc_feature 70: n = A,T,C or G
tatgtagggaaatctgaaaaaatggaaaaaacacttgcctgaggccaggtgcagtggctcatgcctgtgntcccaacactttgggaggccgaggtgcatggatcacctgaggtcaggagttcgagaccagtctggccaacatggtgaaaacttgtctctactaaaaatacacaaaattaaccaggtgtggtggcaggcacctgtaatcccagctacaatcccaggtgtaatcctcagcaggaggcttaagcaggagaatcacttgaacccaggaggtggaggttgcagtgagccaagatagcaccactgcacttcagcctgggcaacaagagcaaaacctgaaacgccctctcataaaaaaaaaaaaaa

SEQ ID NO: 49748 - DNA, 258 bp, Homo sapiens
  misc_feature 62, 63: n = A,T,C or G
tgggtacaagtaaaacattctttggattttattcaaagccttattagcactgcacctgaatnntaggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaaca

SEQ ID NO: 49749 - DNA, 518 bp, Homo sapiens
  misc_feature 21, 32, 34, 448, 451: n = A,T,C or G
aacctgtatccgggcccaacntgaaaacatcntngccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgggggcaacaagcaggttcacttacactgttcttgtagatggctgctctaaaaagacaaatgaatggggaaagacaatcattgaatacaaaacaaataagccatcacgcctgcccttcttgatattgcacctttggacatcggnggngctgaccaggaattctttgtggcattggcccagtctgtttcaaataaatgaactcaatctaaattaa

SEQ ID NO: 49750 - DNA, 333 bp, Homo sapiens
  misc_feature 34, 39, 114, 121, 130, 183, 219, 247: n = A,T,C or G
gagtgcgattcagaagatgacgcgggtacgagtnggtgnacaacagtgccctggggaacagcccataccatcgggctcctcgctgcatccatgtctataagaagaatggagtgngcaaggnggcgaccangatactactggcatcaagggacagaagaaaaaggcgctcattgtgggcactgnatgcttggcccccgaatgacccccagatttgactcnacaacgtgtccttattgaggacaacggnaaccctgtggggacacgaattaagacacccatccccaccagcctgcgaagggggaagcgaagtattccaaggtgtggccattgcta

SEQ ID NO: 49751 - DNA, 261 bp, Homo sapiens
tgcaaatagcaataaagaggctggagataaaggtaacaggaataaatttagtcaaactgtgttttgggcttttctatgtctgtgagaagaatttgaacatcataatcaaggaccctgtaattctacaaccagatatatatacacagaggaattgtagcaaatgatatgtgaaagaatgttcattgtagcattattcataaaagctcaaaaaataagctgtccaaatatatatcaaataaggatggataaataattacagta

SEQ ID NO: 49752 - DNA, 311 bp, Homo sapiens
  misc_feature 85: n = A,T,C or G
cacagaaccctctaaatccccttgtaaatttaactgttaagtccaaagaggaacagctctttggacactaggaaaaaaccttgtngagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgttagattaaaacactgaactgac

SEQ ID NO: 49753 - DNA, 428 bp, Homo sapiens
  misc_feature 25, 59: n = A,T,C or G
aaatcttactctgctgttatgaatntttaccatcagcattattttatcatttaatgtgngctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaataagatttgtttgactgcttgtggctttttatgacctgtttgccttttagaaaattggaaaataaagcaagtatatttttaa

SEQ ID NO: 49754 - DNA, 198 bp, Homo sapiens
  misc_feature 29, 65, 112, 174: n = A,T,C or G
ttgggacggaactggtttcctagtggaanttttttttggctatcattgctttaaactcacctgtnaaaacgcgttgctttgggaaagaacttgcacatttatgctgcatggnttctgctgctgctttgtgtgtgtgtgtgtgtgtgtgtgtgtgtgtgtgttttatttgttttncagagaatcaagtctcacactgag

SEQ ID NO: 49755 - DNA, 445 bp, Homo sapiens
cccggttcgtttttcctttagtcaggaaggacgttggtgttgattttagcataccgtatcaaggacagtaactaccatggctcccgaagttttgccaaaacctcggatgcgtggcttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagacgaggaaggctggcatctttcagagtgtaaagtaatcttggaatataaagaatttcttcaggttgaattacctagaagtttgtcactgacttgtgtcctgaactatgacacatgaatatgtgggctaagaaatagtcctcttgataaataaacaattaacaaatactttggacagca

SEQ ID NO: 49756 - DNA, 447 bp, Homo sapiens
  misc_feature 15, 35, 80, 98, 349, 383: n = A,T,C or G
tacatgaccggaagnagaggcaccacgagaaagancacaagcgaaatcatagcatgggacacatttctagcaagagcagngacaaactgaatctagtnaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaaggagggatttatttgcacatggggaaggcctggtaaagtgggtaagttttaatccttaatgctgcaccagatctagaacttgaataggtagngactttttctttttcgggggaggggtgggggtgnacaatgaatgtgaatgacacttcttattcttaatgaaaatctcaatgcatcagagccataattt

SEQ ID NO: 49757 - DNA, 213 bp, Homo sapiens
  misc_feature 27: n = A,T,C or G
gagttcaagacaagcctggccaacttngtgaaaccccgtctctactaaaaatacaaaagattagccaggcatggttggtggatgcctgtaatcccagctactcaggaggctgaggcaggagaaccacttgaacctgggaggcagaggttgcagtgagttgagatagcaccattgcacttccagcctgggcaacaagagcgaaactccgtccca

SEQ ID NO: 49758 - DNA, 419 bp, Homo sapiens
  misc_feature 35, 36: n = A,T,C or G
tttcagctcaactcacagcttctccaagcatcacnntgggagtttcctgagggttttctcataaatgagggctgcacattgctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgctggcccgcaatactgtaggaacaagcatgatcttgttactgtgatatttaaatatccacagtactcactttttccaaatgatcctagtaattgcctaggaaatatctttctctacctggtatttatcaatttttcccagtatttttatacggaaaaaatg

SEQ ID NO: 49759 - DNA, 477 bp, Homo sapiens
  misc_feature 237, 423, 443: n = A,T,C or G
ataattttgaagaatccatatttagccaagattatgaggataaatacctggatgaaaaaagtattaaggaaaaagaaactgtgataatacccaatgagaaaagtcttcaattacaaaaagatgaggcaataacaccattacctcccaagaaagaaaatgatgaaatgcccacgtgtcttgctgtgtgtttgtttaagtggctctgtatactgtgaagaagttgacattgatgctgtnccacccttaccaaaggaatcagcctatctttacgcaccgattcaacaaaattaaaaagctgctgcaaagattttgcagacatacctaacttaagaagactcgattttacagggaaatttgatagaagatatagaagatggtactttttcaaaactttctctgttaagaagaactttcacttgctgnaaatcaactactaaaacttnccaggttctttctcccaagctcactttatttaat

SEQ ID NO: 49760 - DNA, 146 bp, Homo sapiens
  misc_feature 34: n = A,T,C or G
ttgataggaatgaactccagaggctgggcctgangagggaggtggtcgctcaggcctggtgctcagtcgtacgacctgtacctctcaacttttgccctatctgttaaatatatgctatgtcattaaatgcttttaagtaaaaaaaa

SEQ ID NO: 49761 - DNA, 222 bp, Homo sapiens
  misc_feature 33, 68: n = A,T,C or G
tttagaaatacatttagtaaagtccccaagacnttagtcttacatttaaacttttttctttaaaacanggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaaaaaaaa

SEQ ID NO: 49762 - DNA, 567 bp, Homo sapiens
  misc_feature 34, 67, 530: n = A,T,C or G
ataagtggttttcttcaggaaaataaatatcatngtattatctgtgttaaaatggtttttgcctaanatataatttttaatttggcttttcttatttaaaattccattatcttatgaataagcacttgaatcagtttttaaaatatttagtctaagatgattcaaagtagttttattttaatacaggacttttaaatggcagtatttcatttcctgtcaattatgttggtactttccacaaatctataaagaaggataaattgtaccatcattttattataatcctcaagagaaaatgtgtaattcaaaagattaatgtgtattaaaacacattatgtatcttagtacatttctatcagtacttttattaatatttgtgaaagaagacagcttaatagtaggtagcttagtaggttctccagtacttttgtgctatcaatgagtctctcaaaaaataattaggtaggccaggcacaatggctcacacctgtaatgccagccctttgggaggccgaatgggcagatcactngaggtcaggagtttgagaccaggcctcgccacattgg

SEQ ID NO: 49763 - DNA, 426 bp, Homo sapiens
  misc_feature 33, 69, 246, 358: n = A,T,C or G
aatagcaaattcacctacacagttctggagganttttgaccgaaacacactggggaatggagcaaaacngtctttgaatatcgaacacgcaaggctgtgagactacctattgtagatattgcaccctatgacattggtggcctgatcaagaatttggtgtggacgttggcctgtttgctttttataaaccaaactctatctgaaatcccaacaaaaaaaatttaactccatatgtgttcctcttgntctaatcttgcaaccagtgcaagtgaccgacaaaattccagttatttatttccaaaatggttggaacagtataatttgacaaagaaaaatggatcttctctttttttgctgntccaccaaatacaatcaaatgctttttgtttatttttttaccaattccaatttcaaaatgctcaatgg

SEQ ID NO: 49764 - DNA, 308 bp, Homo sapiens
atatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccggcattctaatgccaggttgctgtagggtaacttttgaagtagatatattacctggttctgctatccttagtcataactctgcggtacaggtaattgagaatgtactacggtacttcc

SEQ ID NO: 49765 - DNA, 322 bp, Homo sapiens
ttttccaccctaagtagctaaatatattcaacgctgtcaaccattcctcgattcactttatttccctgaaaaaattttttatgtcttcttgcaaaaagaaatcttgtagtatagtagaattaaaccatgctgcatttataaatatttgctctagtgtattgatggctctcttaaaagctgccattcaggccgggtttggtggcgtgtgcctgtattcccagttacttgggaggctgaggcaggaggatcccttgatcccagagtcagggctacaacgagctatgatcaattgagccaatgcactccagccttgaaaaccctg

SEQ ID NO: 49766 - DNA, 344 bp, Homo sapiens
acttgaaaaacttaatttttatgatttgttgtgataatcaatggtgatgagtttcactgagtaatggtagatgaggttgttttagaccatctgccttgtgatgttttgctggattccaaaacagaaataaaaccaaccttgtgagggcatcacagagtactaaagcagtgaggaattttgagtaaagaaggatagtcatagagtgagcttgttatttttgatggattttgtcctttaggcatctccagaactgactgctgcgtagttgaggaactaagaaaatttttgcacaaagtttgagccctagtaaaacatcttagactgtgagttggaattctaaatgg

SEQ ID NO: 49767 - DNA, 190 bp, Homo sapiens
tgaaccagaaatgccatttgccaaacagttgtaactagaaatttgattctcacagtccattcttttctttgtccttaagatgacattgttagtgttcacgtcccatgttcagtgccaaaccggcaatgtaaaaagtatcctgtgtggcttaacaggaaatctgttatgtctctttatttgaaaccagttt

SEQ ID NO: 49768 - DNA, 580 bp, Homo sapiens
  misc_feature 564: n = A,T,C or G
tttgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgctttcccatctgtctatctatctggctggcagggaaggaaagaacttgcatgttggtgaaggaagaagtggggtggaagaagtggggtgggacgacagtgaaatctagaggtaaaaccaagctggcccaaaggtgtcctgcaggctgtaatgcagtttaatcaagaggtgccatttttttttggtcaaatgattttaattattgggaatgcacaatttttttttaatatncaaataaaaagttaaa

SEQ ID NO: 49769 - DNA, 511 bp, Homo sapiens
  misc_feature 34, 429, 448: n = A,T,C or G
ggatgaatcaaccattgacaatctaaacaaaagnctacaagtctttgtgttggaatatcttcatttgtaatactctgatttagtttaggataattggttctagaattgaattcaaaagtcaaggcatcatttaaaataatctgatttcagacaaatgctgtgtggaaatatctatcctatagatcatcctattcttatgtgtctttggttatcagatcaattacagaataattgtgttgtgatattgtgtcctaaattgctcattaatttttatttacagattgaaaaagagggccgtgtaaagaaaatggaaaataaatatctttcaaagactcttttagataaacacgatgaggcaaaatcaggtcattcattcaacgatagtttctaaacagtacttaaatagcggttggaaaacgtagccttcantttatgatttttcatatgngggaatctattacatgtaatacaaaacaaacatgtagtttgagggcggcaggatttctttggg

SEQ ID NO: 49770 - DNA, 234 bp, Homo sapiens
  misc_feature 39: n = A,T,C or G
tacccaatgagaaaagtcttcaattacaaaaggatgagncaataacaccattacctcccaagaagcaatacagttaaaaataaaaaggaaagaaagagagagaaagaaatgaaagaaagagaaaaaaagaaagaagaaagaaagaggaaggaaagaaggaaggaaggagaaagaaaaaaagaaaaaagaaagaaaagagaaagaagaaagaaagaaaagagaaagagagaacgg

SEQ ID NO: 49771 - DNA, 542 bp, Homo sapiens
  misc_feature 340, 420, 484: n = A,T,C or G
agatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgctgcattttcagaatcatcttttgaagctttctgttgatgttaactgagctactagagatattcttatttcactaaatgtaaaatttggagnaaatatatatgtcaatatttagtaaagctttcttttttaatttccaggaaaaaataaaaagagtatgagcttctgtaatncatgggcaggtagctcatttgagataaaggcaaatgccaaacactagcttggattaatcccatnttactgggaaagcctaattgaatgggggaatcaatacaggctatgaaaattttactaa

SEQ ID NO: 49772 - DNA, 302 bp, Homo sapiens
  misc_feature 39: n = A,T,C or G
gtcagttcctgtgtgtagacagtaaggaaaaaaaggcgngctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggattttcctggctttcgtttaatacaatagaaaataaagtattacaccgg

SEQ ID NO: 49773 - DNA, 524 bp, Homo sapiens
  misc_feature 346, 436: n = A,T,C or G
gggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattaggttaggaacttcagatcatcagatcagctcaaatgggtttcttggaattttatatttgacaatatttatactataccaaactcatttgcagtcttaggtttgnttggttaaaacattttttaaagcagtaaggttatagaaaatggtttcatttaatggaaggctggggaatgtccagcatcaaccctatggnatgcattcccagtggccttctcatctggggccctggaacctttggttcaagggcttagggggagaacagggccacatggcaacagcca

SEQ ID NO: 49774 - DNA, 301 bp, Homo sapiens
gcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccgtgtgctgggccctgcaattggaatgttgccagatttctgcaataaacacttgtggttgcggcaaatat

SEQ ID NO: 49775 - DNA, 152 bp, Homo sapiens
  misc_feature 121, 136: n = A,T,C or G
aatttaggcttttggtgggttggacccggaatcctaacaagtccagcaattagccaggcagcccagctttatcagggaaaaccaaacggagattttgagaaaagaggtttcggccattggnggaacaaagctggantggattcaaaaaaaga

SEQ ID NO: 49776 - DNA, 416 bp, Homo sapiens
  misc_feature 293, 384: n = A,T,C or G
atttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgcgctgttccagtatatgcaatacactttaatgttttattcttgnacataaaaatgtgcaatatggagatgtatacagtctttactatattagggttataaacagttttaagaatttcatcctttgccaaaatggnggagtatgtaattgggaaaatcataaatcctg

SEQ ID NO: 49777 - DNA, 129 bp, Homo sapiens
  misc_feature 38, 84, 95, 109: n = A,T,C or G
ggttttcggtgcgccgcggtgcctcacagcctgtaatngcagcactttgggaggccaaggcgggcggatcacgaggcaggagancggaaaccatnctggctaacacggngaaaccccgtctctaccaaa

SEQ ID NO: 49778 - DNA, 474 bp, Homo sapiens
  misc_feature 286, 426: n = A,T,C or G
tcaaaaaaggcagatgaaatttcttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgcattaatttagtaagcctaatataaacaaatatttgtattatttttgntagcaggaaagagtgattaagtgaggttatttacccctaaatggccattctgcattgtatttcaggctggaaatgaattattctttaccagttttggaaacactttgaaatatcctaaggtaacttggaagctgggtagnatatcaaattaatttgctacctaataacatagaaagtaaatatctttg

SEQ ID NO: 49779 - DNA, 396 bp, Homo sapiens
  misc_feature 25: n = A,T,C or G
actgcagagacctgaaattctgccntcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggattccttcgacttctctccagccgagcttccagacatcacatatcactgcaaaaatagcattgcatacatggatcaggccagtggaaatgtaaagaagccctgaagctgatggg

SEQ ID NO: 49780 - DNA, 331 bp, Homo sapiens
  misc_feature 36, 48: n = A,T,C or G
tacggctgaacagacttcccgctgctggtcgtaggntttcatggtganggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccagtt

SEQ ID NO: 49781 - DNA, 447 bp, Homo sapiens
ttctgcagtattacctcaacgagcagggagatctgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacattttgacttttttttctcatattttaaattactacaagattattaaagataaaatgatttgaaaaaaaaaa

SEQ ID NO: 49782 - DNA, 521 bp, Homo sapiens
  misc_feature 289, 410, 415: n = A,T,C or G
gtgggtccaatggtaaatgacggatttggaagaggaaatagacatcccttctcctgtgggtttgggattggagtcagaatggccactgtgaggacacctggtgatccctggaccctcactaagacaagactcagagggacaccaagcagcagggggaagtcaagagagaataaaatgctaaagactttttgctttaagagttgaagagatatatatttgatatatatttattatgtttggaaaccataaaatgaaaccaataggatgaatgaatggtttttattcttgntaaacaagtatttatttggacccactacatgctttgtatagttggctcaaccttcaaactctacccattatgaagctactgtttaccatgtccactgcctatttctaatctagccaccttnacctnttacctggagcgtggggaccacactacatctatacagaaaattattggttagaaacaaccccattatttcactattacagataacagtaggaaaatgtctttgctg

SEQ ID NO: 49783 - DNA, 220 bp, Homo sapiens
ttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaaaaaa

SEQ ID NO: 49784 - DNA, 198 bp, Homo sapiens
gcacctagcttgtcatattgtgtttattctccaggctattgcttgcttcagctgcagcctgctgtgctggctgctggggtcgataggcttttgtcgtaataggcagagatgacttgcatcccagctttccaccaaccaaattcaaacattcactgcttatttgttacagactgtaattattaaagtccctgagagctg

SEQ ID NO: 49785 - DNA, 510 bp, Homo sapiens
  misc_feature 32, 33: n = A,T,C or G
taaggtgactcacacagacttaaagcctgaanncatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgacacagttctgccggcagatatgtttcaagacgctgtaaacctctgaaggaatttatgctttctcaagatggtggacatgagcgttctttgact

SEQ ID NO: 49786 - DNA, 489 bp, Homo sapiens
  misc_feature 38: n = A,T,C or G
ggactacagagccccgaattaataccaatattagggcnatgcttttagattaaaatgaaggtgacttaaacagcttaaagtttagtttaaaagttgtaggtgattaaaataatttgaaggcgatcctttaaaaagagattaaaccgaaggggattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtaccgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggga

SEQ ID NO: 49787 - DNA, 173 bp, Homo sapiens
  misc_feature 31: n = A,T,C or G
cttatactttagctcccacaaaatagtgctnggaagtcttgtgcaaaactccacccgccttcacaaactttgtgaaaatcaagtttattagcctgtggaattcatgaaaaaaactgaatactttctactgtcaaataactctgaaatgcccagtaactggataagaaagatgt

SEQ ID NO: 49788 - DNA, 261 bp, Homo sapiens
  misc_feature 22: n = A,T,C or G
agcacaaatgctaggcctctgntgcatggctgtacaaagaacataagagtctatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggcctgaggaccagggctggcagatgttgtctacctgctgaagaataaagatttcttttggtaaaagaaaaaa

SEQ ID NO: 49789 - DNA, 141 bp, Homo sapiens
tttacttgaaaaactcttgatcaagaatttgggtgggagaaaagaaagtgggttatcaagggtgatttgaaattttctgcagcattaaagctggcgcttaataagaataagtaataataaagaaatttctaacatcccaaa

SEQ ID NO: 49790 - DNA, 452 bp, Homo sapiens
gttgaaaaccttttcggtgcagatccattggagatgaactctaggcacaggtgattggatgtgctgtttaggatcagccccagaagttcatttttagtgaacgtgcccagtggacgtgaggaactgtcttttccatcatatacctgatgaaaattcacagcatgagtccctctatgccttcattggattcttatgttagcaatgttaataaacaatccaaatcttcaaagatgcagttttaaacaatacttaaaaaggcatatagtttacagaaagataaatgaaggacttagagctaaatcatatttgttctttaaattttatctttaccattaacactggaggcaaaagattccattcttgtcagatcattttatattcattactttaagagctctttctggggtcatttaaaattaaaataaatatttctttacatttccaggaaaaaa

SEQ ID NO: 49791 - DNA, 298 bp, Homo sapiens
aatggcgattcagcagtcactggggatgctggtgccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacc

SEQ ID NO: 49792 - DNA, 193 bp, Homo sapiens
caagagatctcgaaccctgtctagaaggaatgtatttgtgtgctaaatttcgtagcactgtttacagttttcctccatgttatttatgaattttatattccgtgaatgtatattgtcttgtaatgttgcataatgttcactttttatagtgtgcctttattctaaacagtaaagtggttttatttctatcgcc

SEQ ID NO: 49793 - DNA, 442 bp, Homo sapiens
  misc_feature 375, 400: n = A,T,C or G
cctcacctcggtggggcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatataggtagtttgtagagtgatttccccccagttcttgaacatggnatcttcacatcttggccttggcagntggctattcattattaaacactaaaactttgggggtcttgcc

SEQ ID NO: 49794 - DNA, 223 bp, Homo sapiens
  misc_feature 20: n = A,T,C or G
aagcagtgcatagagggaantttataacattgggtgcatatattagaaagggaaatagacttaaaaaacctaagcttccattttaggtaactagataaaggagggctaattaaactcaaagtaagcagaagaaaatgaataataaaaattagggcagaaatcaataaatttgaaaacaggaagtcaataaagaaaatcaacaaaaccaaaaaaaaaaaaaaaa

SEQ ID NO: 49795 - DNA, 171 bp, Homo sapiens
  misc_feature 32, 34: n = A,T,C or G
actagccacacccccacggaaaacagcagtgngnaacctttagcaataaacgaaagtttaactaagctatactaaccccagggttggtcaatttcgtgccagccaccgcggtcacacgattaacccaagtcaatagaagccggcgtaaagagtgttttagatcaccccccc

SEQ ID NO: 49796 - DNA, 550 bp, Homo sapiens
  misc_feature 33, 34, 489: n = A,T,C or G
attattggtatctgagactcacacagtactggnnataatgcttattcacaccagcaggacagaaaaaaactcataatttaaggggcattgggagaatattcattaggatcttatttcaataataggaaataattattgcttcactaaatgctattctgatactgactaataaatcttaaaagcaagacccaaataaggataaactgtttttaagcacctgaactatgtctcagaaaaaaagctcaagtgtatttgtaggaatacaaaaatatccagcacacaatagagatagaaaaaacaattataaaatttgtatggaaacacaaaagatactggatagccagaacaaagctggaggctcacacttgctaattttgaaatatattataaaggtacagtaataaaaacagtatggtattggcataaaaacagacatttagactaatggaataaaatagacagccagagataaatcaatgcatatgtagncaacttattctcaaaaagggtgcatgttacacatgggggaaaaaataatattgccaacaaa

SEQ ID NO: 49797 - DNA, 494 bp, Homo sapiens
  misc_feature 419: n = A,T,C or G
gaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcaagtacctctcaagctagtgtttctagctaaataaatgggtgtatataattttatggngggaaaagactgactgctggtatgatttccttcaatgtgcataatgataaaataaataattttaatattcttttg

SEQ ID NO: 49798 - DNA, 297 bp, Homo sapiens
  misc_feature 213, 219, 222: n = A,T,C or G
ggttaatgggtacaaaaaaatagttagaacaaataagatctagtatttgatagccaagcatggtggcatgtgcctgtggtctcagcagctcaggaggctgagttgagaggatcacctgagtctgggtggtggaggttgcagtgagccgagatcacgccactgctttccactctgggtgacagagtgagaccccatctcagggaaaaaaaaaangatccngtntttgatagcacagcagggtacctatactaaaaaataatcatacattttaaaataattgaaatagtataatcggat

SEQ ID NO: 49799 - DNA, 421 bp, Homo sapiens
  misc_feature 20, 46, 81, 82, 83, 84, 85, 90, 107, 118, 234: n = A,T,C or G
gatgatagattttgatgatnatgatgatgatgatgatgaggacggntctctttttccaacaagagagccaagaagccattnnnnnccatntgatctgttgccaatgngtccatttggntgtcagtgctattcacgagttgtacattgctcagatttagggttgacctcagtcccaaccaacattccatttgatactcgaatgcttgatcttcaaaacaataaaattaaggaaancaaagaaaatgattttaaaggactcacttcactttatgggtctgatcctgaacaacaacaagctaacgaagattcacccaaaagcctttctaaccacaaagaagttggcgaaggcttgtatcttgcccacaatcaactaagtgaaataccacttaatcttcccaaattattagcagaactcaaaaaa

SEQ ID NO: 49800 - DNA, 532 bp, Homo sapiens
  misc_feature 375, 499: n = A,T,C or G
ttacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggataccgttgttcctaatgtggatctaccacccctgtgttcatcgagattccggtctggacctcctggagaagagcccaagtgctagccagttcattgcaggatgtcattgaaaattcacaagataattcagaaagaggacttatgcatttctccaggaaagcttgtcttgggttctatactgngatctcatttgcctcgactacgatggaaacattttggatgcctgcacatttgctttggtaggcggctttaaaaaatgtacagttgccttgaagttactataaatgaaagaaactctttagcagnagttaatttaaaagaaagaaaaagttatttgga

SEQ ID NO: 49801 - DNA, 191 bp, Homo sapiens
  misc_feature 80: n = A,T,C or G
gtataaggatattagctgtgatgggactcactgcattatttttttttagtgaattttatgaaatccccgttccattcaanaggcacatgtttaaaagagctttgtcgttggtgttaatgggggaatgtgttccttcattgtatttgggccttttgtattgcactcttgatattaaattaaatgtgccttga

SEQ ID NO: 49802 - DNA, 265 bp, Homo sapiens
  misc_feature 46, 169: n = A,T,C or G
ggtagtctccttgatctgctgattgcattattttaatttgcttttntgggaaagcaggttttgctaaaagctgtacagactttttcttttgtacctagcagtactttatatagtatagctttggccatgtagcattttaagactcaattttaaaaaattattaatctgntgctgactcttaattcctatttcaatatgtgtttccttgaagaattcaggatacaacttcttgtgtatgacaagctttcttcacacactatttttg

SEQ ID NO: 49803 - DNA, 357 bp, Homo sapiens
  misc_feature 32, 321: n = A,T,C or G
tgaagctctgccttctgtatcctatgtatgcngtgtgctttttcttgccagcttgggccattcttgcttagacagtcagcatttgtgtcctcctttaactgagtcatcatcttagtccaactaatgcagtcgatacaatgcgtagatagaagaagccccacgggagccaggatgggacttggcgtgtttgtgcttttctccaagtcaagcacccaaaggtcaatgcacagagaccccgggtgggtgagcgctggcttctcaaacggccgaagttgcctcttttaggaatctctttggaattggggcacgatgactctgagntttgagctattaaagtacttcttacacatagaagag

SEQ ID NO: 49804 - DNA, 484 bp, Homo sapiens
  misc_feature 36, 420, 464: n = A,T,C or G
ttcagacatagtagtaagtggacggggagcatgctngattgctgggagagaaatgagaagacaagcttgattcaggactgtttttataagggatcaaatgaaaaaatttacttaaaagtcacaaactataaaatgtagtgtacaaaggctagctatctttatagaactaagaactgtgaatttcagtgactcagcaatcaataaaaagtcaataacacacacatcttgtagatgatggcattttaaattttctcaatgaatagtaaagagagattaacttagttatatttaaagcaaatagaatcaattaagtataaagaatgaatattataaattgatatatagaacgactattaagaaaataaaaatgttggctgggtgaggtgctcttgcttataatcccagcctttgggaggctgnggtgggcagtcacttgcgctcaggaggttcagaccagtcttggnaatgtgggggaaccccatct

SEQ ID NO: 49805 - DNA, 287 bp, Homo sapiens
  misc_feature 19: n = A,T,C or G
tctgcagaagaggagaagnggaaacacaagaagaaacgcctggtgcagagcccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaa

SEQ ID NO: 49806 - DNA, 236 bp, Homo sapiens
  misc_feature 46, 47: n = A,T,C or G
tatcccacatttgtttatgcacccactcacccctccaaatcagcannaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttaaaaaaaaaa

SEQ ID NO: 49807 - DNA, 178 bp, Homo sapiens
  misc_feature 50: n = A,T,C or G
gaagggctggtcctgcccttttgagggggtgcaaacatgactgggacctnagagccagaggctgtgtagaggctcctgctccacctgccagtctcgtaagagatggggttgctgcaagtgttggagtaggggcagagggagggagccaaggtcactccaataaaacaagctcatggca

SEQ ID NO: 49808 - DNA, 454 bp, Homo sapiens
  misc_feature 263, 352, 370: n = A,T,C or G
gtcatcttccctggcatgatttgaagtagcgccactatcagccaaactcttcatgcaagtgatatggtccatgagaaacagagtaagactcaggacccaaaaaggtgagaagtccaatgggaagtgcccatgagggaagcctgcaagttgctgatagggcagcatgagtttgtcaagtaaatatcagaagaattacggaaatagttgatgtctcatttaatcttactcctttaatcttcaggatttaatctctcttttaaggntttagagatcgacttttgaaattatcttggatcaaacaaatcggacattaaataaatatattaaagccatgtgtaacagtgtatcaggnaagcaatcatgtgatcangggcattctcactgcattttattaaaacgtttttccttcatgtagactacccattattgcatctttggggatccaaaagacccg

SEQ ID NO: 49809 - DNA, 188 bp, Homo sapiens
ttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtgaaat

SEQ ID NO: 49810 - DNA, 419 bp, Homo sapiens
  misc_feature 374, 380: n = A,T,C or G
gagcttgtggacaattgtataggatcaagaattcacatcgtgatgaagagtgataaggaaattgttgggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtatccttgacttacactagattttgttttggcttataatgacaagaaaatggaattttttttcccactttctaatgtttaaatcccataaagctaagtttcccgttaaagggaaagtgctttgaagatgtgacccanttttgnaagttaatcatgattatcctggaaaaagaagaaaagagc

SEQ ID NO: 49811 - DNA, 431 bp, Homo sapiens
ttataccctcatgagcatgtttggccaacctcttgtatgagaaacaggtttgggccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcaagtgtcaggcatgggagtcattgtccacatcatcgagaaggacaaaatcaccaccaggacactgaaggcccgaatggactaaccctgttcccagagcccacttttttttctttttttgaaataaaatagcctggctttcaaaa

SEQ ID NO: 49812 - DNA, 496 bp, Homo sapiens
  misc_feature 20, 34, 52, 130, 136: n = A,T,C or G
tacgtgtcacgtgatacctnttaatctcagcatncggagctccaggaagggnaaatttcaagtcagatagaattctatatataccatttctttggaaccttcagccctcaagattccaacatcatgaccncagttncaacacagttgtccttagtcctcatgtcactgcttttggtgctgctgttgtggaagcagtagaagccggtgatgcaatcgcccttttgttaggtgtggtctcagcattacaggcatttgtgcctgcttgggggtatatgcaccgaaaaagaaatggacagatgtgactttgaaaggcctactgagtcaaacctcaccctgaaaacctttgcgctttagaggctaaacctgagatttggggtgtgaaaggttccaagaatcagtaaataagggagttcacatttttcattggttccatgaaatggcaacaaacatcatttataaattggaaaaaaaaagttttctttacaacaaataatgc

SEQ ID NO: 49813 - DNA, 170 bp, Homo sapiens
taaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccc

SEQ ID NO: 49814 - DNA, 137 bp, Homo sapiens
tatgatccaagttatcagctctttccaactttaaaaattttgttaaaagcaccttgcttagaaaattttaaatatttatgtctgcaacaattgtctcaaaataataaactgtgcaattcttgtcattaaaaaaaaaa

SEQ ID NO: 49815 - DNA, 339 bp, Homo sapiens
  misc_feature 51, 315: n = A,T,C or G
ggcaagactatccattttacacttgctttatttttcattacctgtagcttnggcagatttgcaacagcaaattaatgtgtaaaattggattactactacaaaaccgtttagtcatatctatctaatcagatcttcttttgggaggatttgatgtaagttactgacaagcctcagcaaacccaaagatgttaacagtattttaagaagttgctgcagattcctttgccactgtatttgtaatttcttgcaatttgaaggacgagtagagggttaaagaaaaatcaggttttggtcttaaaaatgcatttaagttgnaaacgtctttttaagcctttgaag

SEQ ID NO: 49816 - DNA, 316 bp, Homo sapiens
cagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctgcagcattgcatgattctccagtatatttgtaaaaaataaaaaaaaactaaacccct

SEQ ID NO: 49817 - DNA, 490 bp, Homo sapiens
  misc_feature 22, 52, 434: n = A,T,C or G
aggacgaaaccatgaagagccngaggcttcttgccatcctggcgcttagcgntagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctgcacctgattttgtatccccctgtagcagcattactgaaatacataggcttatatacaatgcttctttcctgnatattctcttggctgggctgcaccccttttttcccgccccagattgataagtaatg

SEQ ID NO: 49818 - DNA, 549 bp, Homo sapiens
  misc_feature 37, 420: n = A,T,C or G
cagttgtccccacagtagacacatatgatggccgagntgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcaagctggatgaccagagtgctgaaacccacagccacaagcagtccagattatataagcggaaagctaatgatgagagcaatgagcattccgatgtgattgatagtcaaggaactttccaaagtcagccgtgaattccacagccatgaatttcacagccatgaagatatgctggttgnaggaccccaaaagtaaggaagaagataaacacctgaaatttcgtatttctcatgaattagataggcatcttctgaggtcaaattaaaagggggaaaaaaatccaatttttactttgcatttagtcaaaa

SEQ ID NO: 49819 - DNA, 482 bp, Homo sapiens
ttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgtctggcccgcaatactgtaggaacaagcatgatcttggtactgtgatattttaaatatccacagtactcactttttccaaatgatcctagtaattgcctaagaaatatctttctcttacctgtaattaatcaatttttcccagtattttaatacgggaaaaaattgtattggaaacccttaggatgcagtga

SEQ ID NO: 49820 - DNA, 317 bp, Homo sapiens
  misc_feature 18: n = A,T,C or G
gtttaaaaaataacactnggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatct

SEQ ID NO: 49821 - DNA, 321 bp, Homo sapiens
gctatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaacgaatgttgaattctcatgcttttaggtgtacttcctttttagaattttcagttttctgctatttttaccgtaactatttcgtttaaatttgtttcatttaagtttcctacacgctaacttcgttgtgcgattgaaataaaattgcagtatatagaa

SEQ ID NO: 49822 - DNA, 298 bp, Homo sapiens
gtgtgcagccctggaggcagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgg

SEQ ID NO: 49823 - DNA, 467 bp, Homo sapiens
  misc_feature 389: n = A,T,C or G
taaaagactattctactatacattctaatccttagaatattgataaaagagttactaaatctttatattattttatgtatatatttataaaaacattccttaatctgtgatggcacacaattttatctttgaatcagctaacgaaggtaaaaaaaaagaaaaaaaagtgcattcctcttccaaaaccaatagccatttagtgaaatctattagtttaaaaacacacataaaatccactgttgcaatcacaaccgtcatcctgtcctttgcacagctggctgatccaatcatcctaattgtcttcgttagttattcatactttccttggttttctgttgcaaaaattattcaaactaaatgaaaggaacttgaaataataaaaaagagtntcagaatagaagaaaaaaatacctgaggaccagaagtagaaagaggtgagttttgtcattttaaaccgaaaaacaaaa

SEQ ID NO: 49824 - DNA, 359 bp, Homo sapiens
  misc_feature 32, 33, 337: n = A,T,C or G
tagaaaggggaaataaattaaagtacacaagnncaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggcaggtgaatttactactttctaaagttattgatcttcccttttatgtaaaatggagnagtgatcctatatttcacattg

SEQ ID NO: 49825 - DNA, 471 bp, Homo sapiens
  misc_feature 339, 428: n = A,T,C or G
gacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctaggcactagcctgacttttaaggcagtgtgtctttctgagcactgtagaccaagcccttggagctgctggnttagccttgcacctggggaaaggatgatttatttgaattttcatatatcaaccaaaagctgaatggaaaagttaagaacattcctaggnggccttattctaaaaaagttcttccggccggtttggtttcaat

SEQ ID NO: 49826 - DNA, 436 bp, Homo sapiens
aggatcaacatgccttcggctagaggatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgtcaacagtgttgtgccagcctacaggaggaaaggccagactcacagaagggtgttcatttagaagaaagcaacactaatgattcaaacagcttcctgaattttgtgttgctcacagaaagccttatcataaattccataattctaattaatttaccaagataatgtaattacatttgggtttgtaagggtatacagcagtaatctcctatttgggggcaggttttcaataaaggttttgattatgggcaa

SEQ ID NO: 49827 - DNA, 352 bp, Homo sapiens
  misc_feature 36, 39, 320: n = A,T,C or G
aatgggccgcgagtttgggaatctgacgcggatgcnttntgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagctgcattgtaggnctcaaagacacaataaacttcctatggctgct

SEQ ID NO: 49828 - DNA, 362 bp, Homo sapiens
  misc_feature 15, 46, 69: n = A,T,C or G
acagcttttcgcttnctacattcagcccgtctggtaaacttgtccngattgaatatgctttgctgctgnagctggaggagccccgtccgtgggaattaaagctgcaaatgggtgtggtattagcaactgagaaaaaacagaaatccattctgtatgatgagcgaagtgtacacaaagtagaaccaattaccaagcatataggtttggtgtacagtggcatggccccgattacagagtgcttgtcacagagctcgaaaactagctcaacaatactatcttgggaccaagacccattcctacagctcagctggtacagagagtagcttctgtgatgcaagaatatactcagtcaggtggggtcg

SEQ ID NO: 49829 - DNA, 232 bp, Homo sapiens
  misc_feature 13: n = A,T,C or G
aatgtgctcaacncaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaaaaaaaaaaa

SEQ ID NO: 49830 - DNA, 357 bp, Homo sapiens
tattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtaagccataccttgaagcacagtgtttgtacataagtaaatatcttgattctaaattaaatccagatttaactaatatatattattttatatctttggtggattaaaatg

SEQ ID NO: 49831 - DNA, 280 bp, Homo sapiens
  misc_feature 34, 35: n = A,T,C or G
tgagtactttttctttgaagttttagcggtcaanntgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcccttagttttaacagttcactttttacagtgctatttactgaagttatttattaaatatgcctaaaatacttaaaaaaaaa

SEQ ID NO: 49832 - DNA, 130 bp, Homo sapiens
tttatggggctgcttttgtcacactagcatagagaatgtgttgaaatttaactttgtaagcttgtatgtggttgttgatcttttttttccttacagacacccataataaaatatcatattaaaaaaaaaa

SEQ ID NO: 49833 - DNA, 433 bp, Homo sapiens
  misc_feature 24: n = A,T,C or G
tcctcagcgcttcttcttttttgntttggtgcttctgagatgtgggcttgcggcacgctgttgctataatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaagggcttccagataagcagcccaggaagaaatgaaaactcctctgatggggttgggggggtctgccagctgggggccct

SEQ ID NO: 49834 - DNA, 220 bp, Homo sapiens
gggtgactatagtttacaataatctgttgtataatatatttcaaaataactggaatgtaatttgaatatttctagcataaagaaaagacaaggtggggcgtggtggctcatgcctgtaatcccagcactttgggaggccaaggtgggccggatcacctgaggtcgggagtttgagaccagcctgaccaacatggagaaaccctgtctctactaaaaaaaa

SEQ ID NO: 49835 - DNA, 160 bp, Homo sapiens
  misc_feature 11: n = A,T,C or G
ttagcctgttnttggtaggcacatgcctgtaatctcagctactgaggaggctgaggcaggagactggcttgaacctgggagatggagattgtagtgagctaagatcatgccactgcactccaacctgtgcaacagagcaagattccatctaaaaaaaaaa

SEQ ID NO: 49836 - DNA, 455 bp, Homo sapiens
  misc_feature 338: n = A,T,C or G
ctaagctttttccttaaaaatgttgaaaaaggagagaaaaaacccaaggcaagtggaaaaaaggaaatgctgaggatgagaagaaaaagcaatgaaatagaaacatgagaaaaatcaataaaaccaaagttagttatttgaaaaaacaacaaaattgacaaaactttaatgagtttttctaacaagaaaaattaggaatgaaagaggggacattgctactgaccctgcaaaaatcaaaaggttataagggaatactataaccttatgccaacagattaaacaacctggatgaaatgggaaacattcttagacacgaattacctaaactgactcaggangaacagaaaagtataatagacctatagcagggaaataaaaggaaattaataatttaacatattctcacaaaggaaaagcccagacccagagagctttactgggtaattttattaaac

SEQ ID NO: 49837 - DNA, 538 bp, Homo sapiens
  misc_feature 468: n = A,T,C or G
ggtgaatatggaacttgattgctattccatttacctcagagtatgttctgctgcttgaactttacttaatcctgcttgatgaggttggaagaaaagtctattcatattggctagttccaccttgtcataatcaaagagtagcaactaaaatgaaaatagtggtattctgatgaaaaacataccaaaaaactaaacatatcaaaaaataaattagagagctttacatttaattagtttagcagtttgataataatattagctaactctacaacactaggtgccatatattaattcattgaatgctcatgtgaggcatgtaggtctattatccttatttttaaaatgaggcaactacaacacttgtccaaaggccactcatctaatatgaagtgaaaatgggatcaaattcaagcattctcaatccagcatctgcacctcaaccacaatgctgggctgcctctcttaaanaatttactcagaaattaaagattaattccctttcattccattttttaaatctgggggcaaaaacctactt

SEQ ID NO: 49838 - DNA, 465 bp, Homo sapiens
  misc_feature 375, 423: n = A,T,C or G
cgccagagaagaaagctatacgggatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgcttatttcatttctgtaacagntgatatctggctgcctttttataatgcagagtgagacttccctaccgngtttgataaatggtgtccaggtctattgccaagaatgggtgg

SEQ ID NO: 49839 - DNA, 403 bp, Homo sapiens
  misc_feature 12, 36, 53, 350, 359: n = A,T,C or G
gaaagtcatgancttcttcggaaaggtttttcttgngtgaaaaatgaactttngcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatgggggaatataaacttgggtttactgnaataagtgngctgtcatggaaaccgaggctgcatcttggttatagtcatcttg

SEQ ID NO: 49840 - DNA, 474 bp, Homo sapiens
  misc_feature 44, 377: n = A,T,C or G
ctggagtgattttagcagacccagcttagagttcttctttctgngttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgtctggcccgcaatactgtaggacaagcatgatcttgtactgngatattttaaatatccacagtactcactttttccaaatgatcctagtaatgcctagaaaatatctttctcttacctgtatttatcaatttttccaga

SEQ ID NO: 49841 - DNA, 150 bp, Homo sapiens
gtggaacgtgcctgtaatcccagctactcgggaggctgagggaggagaatcgcttgaacctgggaggtggaggttgcagtgagctgagatcacgccactgcactccagcctgcacaatggagtgagactctgtctcaaaaaaaaaaaaaa

SEQ ID NO: 49842 - DNA, 232 bp, Homo sapiens
taagagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaaaaaa

SEQ ID NO: 49843 - DNA, 488 bp, Homo sapiens
  misc_feature 328, 356, 455: n = A,T,C or G
aagccctcatgtgcagtagagatgcatgtttcatcaaagaacaaacatccttgcaaatgggtgtgacagcggttccagatgtggatttggcaaaacctcatttaagtaaaaggttagcagagcaaagtgcggtgctttagctgctgcttgtgccgctgtggcgtcggggaggctcctgctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagntataaatatttggtaatatttattaagngactatagaatgcaactccatttaccagtaacttaattttaaatatgcctagtaacacatatgtaggataatttctaggaaaccaaacatctaataagnatataatcctggggaaaatatgaggctggaaaa

SEQ ID NO: 49844 - DNA, 291 bp, Homo sapiens
gtgccgccggtgtggctctaaggcctaccaccttcagaagtcgacctgtggcaaatgtggctaccctgccaagcgcaagagaaagtataactggagtgccaaggctaaaagacgaaataccaccggaacgggtcgaatgaggcacctaaaaattgtataccgcaagattcaggcatggattccgtgaaggaacaacacctaaacccaagagggcagctgttgcagcatccagttcatcttaagaatgtcaacgattaagtcatgcaataaatgttctggttttaaaaaata

SEQ ID NO: 49845 - DNA, 348 bp, Homo sapiens
  misc_feature 174, 301: n = A,T,C or G
ttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtgnaggtggcacagggaaccatcgccattggaatggcagcttcactcccggaaagggtgtgcttttcaggaaaagccacctatggagattagggaagaaaagaaagaagacaaggtggaaaagttgcagnttgaagaggaggactttgtaaagtatgaatctttagatgtgtgggta

SEQ ID NO: 49846 - DNA, 129 bp, Homo sapiens
acgcaattctcgattctttgaagagatgacaacaaattttggttttctactgttatgtgagaacattaggccccagcaacacgtcattgtgtaaggaaaaataaaagtgctgccgtttaaaaaaaaaca

SEQ ID NO: 49847 - DNA, 200 bp, Homo sapiens
  misc_feature 49: n = A,T,C or G
tcttagttcaactttaaatttgcccacagggccctctaaatccccttgnaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacccaaaaaaa

SEQ ID NO: 49848 - DNA, 555 bp, Homo sapiens
  misc_feature 29, 30, 420, 527: n = A,T,C or G
atggcaagaaaagctggcaacttctatgnncctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaataccggcatcatctgcatggaggatttgattcatgagatctatactgttgggaaaacgctcaaagagcaaataacttcctgtggcccttcaaatgncttctcccgaggtggaatgaagaaaaagaccacccattttgtagaaggtggagatctggcacagggaggacctgatcaacagcttattagaagaatgaactaagggnctaccatgattatttttctaagccgggt

SEQ ID NO: 49849 - DNA, 520 bp, Homo sapiens
  misc_feature 29, 367, 463: n = A,T,C or G
gagcttgaggaaaccgcagataagttttnttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggtgacttaaacagcttaaagtttagtttaaaagttgnagggtgattaaaataatttgaaggcgatcttttaaaaagagattaaaccgagggggattaaaagaccttgaaatccatgcgcagggggaattgcgncatttaaagcctagttaccgcctttactaacgcagacgaaaatgggaaggattaatt

SEQ ID NO: 49850 - DNA, 509 bp, Homo sapiens
  misc_feature 20, 366: n = A,T,C or G
ctttctgcaaagtccaatgnaagttcttaacaaagggtgaccagatagggtatagaaaggttgactaaaataagaactgaaaaataccctttgcatttcctaactgggagatctctgggaagagggatttcagtggagtagctccaagcagatgccacattatagattgagatgtgaatgaaagatgaattggatcagcagtttagatgttcctcagggaaacttggcttgtttatatgctaaagcagctaacagacagagaaagagagttgaaggctcagaagataattaatgaaatacaaattctgaaagacctgtgtagtgattcatttttcattagaggattggaggcacatttttcactgnaaccataaagtaaggatgggcctggatttagataattttggttttgagaacaggaagttaatggagctcttacttaaaaactgctgtttctcttgaaataagttatgggcggtctactaaaagaccaaaatcagctgggtgtg

SEQ ID NO: 49851 - DNA, 320 bp, Homo sapiens
gtgatctccatgctctttgctgccaccttcatacttctttgccatttggccagttagctgagcgttcaggtgactaggaagtcaggccatcttccccttacgtaacagacataattgtcagctttttctaaatcgagctcagggagcttgctatcggtgccacctcccttcagcatctcagacttcagagacattgcgaatgacttctcctagaataattagatccaagacagaatttgatgactggaggtatcttataggttatcttcaaatttaaaacacttgtgctttcagggactttctctcctagtacaggtggc

SEQ ID NO: 49852 - DNA, 388 bp, Homo sapiens
ggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaaagttcaaggatctagaagacgattaagggaagggtcgttctcagtgaaaatccaaaaaccagaaaaaaatgtttatacaaccctaagtcaataacctgccttagaaaattgtgagaccaagttgacttcaggactgaaacatcagcacaaagaagcaatcatcaaataattctgaacacaaatttaatatttttttttctgaatgagaaacatgaggggaaattggggg

SEQ ID NO: 49853 - DNA, 133 bp, Homo sapiens
  misc_feature 23: n = A,T,C or G
aagggacatgaaaacattctccngcgcataagcctgcgtcaagattaaaacactgaactgacaattaacagcccaatatctacaatcaaccaacaagtcattattaccctcactgtcaacccaacaaaataaa

SEQ ID NO: 49854 - DNA, 475 bp, Homo sapiens
  misc_feature 356, 442: n = A,T,C or G
agaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgtcactaggagacgtggaattgagactaataacttggatgttaacactgtttactgttttttcacatgtagaaacgtctttgngtattttttctacagaggatttctctgatctattttcttgggtctgactctaataattaggtgggaactcatataaaaagggcttnctaaattaaatctattttaataaaggttttact

SEQ ID NO: 49855 - DNA, 204 bp, Homo sapiens
  misc_feature 84, 87, 105: n = A,T,C or G
gttttcatcttgagggggccaatatggggatgtggaaatttttatacaaggttataagtgtttggcatagtacttttgggacantgnggcttcaaaagggccagngtaaaactgctccatgtctaagccaaagaaaactgcctaccatactggttttgtccctggcggggaaaaaaaggggacattgggttccaggtcacaagg

SEQ ID NO: 49856 - DNA, 220 bp, Homo sapiens
  misc_feature 39: n = A,T,C or G
aagctcatgaaagacggcaagtagacgtttggctgagangtccgacggcgacgtgcaggagcaagctccggctctacgacatgtagactgcgcccacgggatgcacagcggccatgcctgatgctgtccccacccttgccccatgcccttgttctttccagacttctgtaggcctaattttcccttataaacatagatgcaggcgtaaaaaaaaaaaaaa

SEQ ID NO: 49857 - DNA, 106 bp, Homo sapiens
gaggcgtacaactagttggcgattaagacttgttatgtgatgttactaagcctgaaatgcgatcaccccgtaggaaataaagcaggcatcttctgggaaaaaaaaa

SEQ ID NO: 49858 - DNA, 432 bp, Homo sapiens
  misc_feature 410: n = A,T,C or G
tgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcaagttttgaattacctgaagacatcaggagaatacaaacttgcagggggttttcttgggaggtcggtcaatgggctcaagagcagctgcttctgtaatgnggcacattgagccagatgaagg

SEQ ID NO: 49859 - DNA, 332 bp, Homo sapiens
tacaccatcaacattcacaagcgcatccatggaagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgccagaaaacgtaatgaggatgaagattcaccaaataagctatatactttggttacctatgtacctgttaccactttcaaaaatctacagacagtcaatgtggatgagaactaatcgctgatcgcagatcaaataaagtt

SEQ ID NO: 49860 - DNA, 163 bp, Homo sapiens
gcaggagtcatagcgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccaa

SEQ ID NO: 49861 - DNA, 443 bp, Homo sapiens
  misc_feature 26: n = A,T,C or G
tttgtgaatgttttacccacatgacntattatgcataaagccaaatttccagtttaagtaattgcctacaataaaaagaaattttgcctgcattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatttaggaaaa

SEQ ID NO: 49862 - DNA, 176 bp, Homo sapiens
  misc_feature 53: n = A,T,C or G
tcttgtaaatttaactggtagtccaaagaggggcagctctttggacactaggnaaaaaccttgtagagagagtaaaaaatttaacacccatagtaggcctaaaagcagccaccaattaagaaagcgttcaagctcaacacccactacctaaaaaatcccgaaaaaaaaaaaaaaaa

SEQ ID NO: 49863 - DNA, 279 bp, Homo sapiens
  misc_feature 15, 193: n = A,T,C or G
ggactgtgccacacncccagtgatccatccaaaaacaaggactgcagcctaaattccaaataccagagactgaaattttcagccttgctaagggaacatctcgatgtttgaacctttgttgtgttttgtacagggcattctctgtactagtttgcgtggttataaaacaattagcagaatagcctacatttgnatttattttctattccatacttctgcccacgttggtttctctcaaaatccattcctttaaaaaataaatctgatgcagatgtggaa

SEQ ID NO: 49864 - DNA, 505 bp, Homo sapiens
  misc_feature 460, 493: n = A,T,C or G
gtgaatattttctcatcttggcttgaggatcaaactttacttggtttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggccacctgaggttaggacttcaagaccagcctggccaacatggtgaaaccccatctgtactaaaaatcaaaaatttgcctggtgtgggggtgcatgcctctagtcctagctctcgggaggcttgaggcacgagaatcactttgacctgggaggcggaggtttgcagtgagtcgaganaacactactgcattccagcctgggtgacagagnggactccacctt

SEQ ID NO: 49865 - DNA, 424 bp, Homo sapiens
  misc_feature 31, 349: n = A,T,C or G
cattgactcgacttcacatgctcagctttcncagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgccagcttgagtgtctgtctcttcctgcccatttccttgaacctcctgctctagccttgcggagggagagtgctgtttgcttttgtctccctctgcttaggaaaagccatcttaatatagtcttcaccaccgtggggttggtttgngattttttttcttccgaagaactcctggtggtattggatttggattttaaaacaaatattgaatttataagcctg

SEQ ID NO: 49866 - DNA, 406 bp, Homo sapiens
  misc_feature 32, 34, 35: n = A,T,C or G
ttgtcaccagattcattacaattcaaatcggntnngttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggttactggtaaattatgttattttttacaactaattttgtactctcagaatgtttgcatatgcttcttgcaatgcatattttttaatctcaaacgtttcaataaaaccatttttcaagatataaagagaattacttcaaattgagtaattcaggaaaaactcaagatttaagttaaaaagtggttggacttgggaacaggctt

SEQ ID NO: 49867 - DNA, 253 bp, Homo sapiens
  misc_feature 23, 33, 95, 167, 170, 214: n = A,T,C or G
tgattattacaaacactgatggnaaagaggtgncccgaagtcgatgcaaaaaatgagttgcttatttcagtctctctttgatatatctgcctttntagtgctgactctatcatgtattcactatttgattttcaggtgaatcacattttttaaagcttttaatctgnttnctcaaaaaatatattttttaaaaatatttactcaggattgttgngagaataaaattgattcgattgatatttcaaaaaaaaaa

SEQ ID NO: 49868 - DNA, 366 bp, Homo sapiens
  misc_feature 44, 89, 141, 164, 289, 320: n = A,T,C or G
tacattaaatgctaagatcatgttgctcaaaattaaaacaaagngggtaaattccaagaattggatttgggccataccattgtcactgnattactgctcatgtcattgcacttggttcatcttccttcttaacttacctgntgccacttgggaatatatatcgnatgatcttaagctttggataaaatgactgaagctggaagaagccggtggttgaaggtcaagcctacactacagtgcacaagttgagggaggccaagaagacttcttaaatcatccttagaaccgngaccataagcagtatatattttcctcttggnacaaaaaaactatttttggctgggaatttttaccatataaaggaat

SEQ ID NO: 49869 - DNA, 255 bp, Homo sapiens
  misc_feature 48, 50, 71, 72: n = A,T,C or G
gtgtagagggaaatttattgcactaaatgcccacaagagaaagcaggngngatctaaaattgacatcctannatcacaattaaaagaactagaaaagcaagagcaaacacattcaaaagctagcagaaggcaagaaataacgaagatcagagcagaactgaaggaaatagagatacataaaacccttcaaaaaattaatgaatccaggagctggttttttgaaaagatcaacaaaattgatagaccgctagcagg

SEQ ID NO: 49870 - DNA, 220 bp, Homo sapiens
  misc_feature 13, 60, 61, 64, 84: n = A,T,C or G
ccaggagtttggnaccagcctgagctttttagtaagacctcatctctactaaaaagaaannganaaacattagccaggtgtggnaacaagcacctgtagtcccagctctttgggaggctgagatggcaggattgcttgagcccaggatgttgaggttgcaatgagtcatgatcatgccactgcactccagagtgggtgacagagcaagaacctgtctcag

SEQ ID NO: 49871 - DNA, 387 bp, Homo sapiens
  misc_feature 28, 63, 179, 235, 238, 249, 294, 365: n = A,T,C or G
atgcataaagtgaatcatttcttctgtntttatttccaaagggtgtttaccctctatttaaangctttgaaaaacagtgcattgacaatgggttgatatttttctttaaaagaaaaatataattatgaaagccaagataatctgaagcctgttttattttaaaactttttatgttctgnggttgatgttggttgtttggttgtttctatttggtggttttttactttgtttttgnttngtttggtttgntttgcatactacatgcagtctttaaccaatgctgtttgctaatgnaataaaggtgtaattatatgagggcattcaactatgcaatggttcttaatattattggggagaagactggnaattttttatttacaatatgtt

SEQ ID NO: 49872 - DNA, 441 bp, Homo sapiens
  misc_feature 34, 67, 68, 233, 356, 370, 412: n = A,T,C or G
atatacacgaatagacatcaaactcaatgctttntttgtaaatttagtgtttttttatttctactgnnaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggnagatattgaggccaagaatattgcaaaatacatgaagcttcatgcacttaaagaagtatttttagaataagaatttgcatacttacctagtgaaactttctagaattatttttcactctaagncatgtatgtttctntttgatatttgcatggtatgttaataagctctagcaaaatanaacatagcaaatggtaaaaaaaaaaaaaa

SEQ ID NO: 49873 - DNA, 283 bp, Homo sapiens
  misc_feature 34, 36: n = A,T,C or G
tttatttgcaccgaaatgtcttgttttgttgcgngntaggaaaataaccaagcacaaagttatattccatcctttttactgattttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaaaaaaaaaaccc

SEQ ID NO: 49874 - DNA, 359 bp, Homo sapiens
  misc_feature 13: n = A,T,C or G
aacatgctgggtnagatcatcggcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggcttccagaagccacatccgcacaattttccacttaaccaggaaatatttctcctctaaatgcatgaaatcatg

SEQ ID NO: 49875 - DNA, 230 bp, Homo sapiens
  misc_feature 24: n = A,T,C or G
gaaaagcgatcctaaaaggaaggncagaagaaaaaatttctgagctgaaaaagcctcagatcttgagataaagctcttactaagcatcaagcaagaaaatttggaggaaaaaaaagattcatactgttgctaaaattttcaagtattgttcaagttctcaagtaaagagaaaaatcccacaaacttctcaataataaacagcaaccaccataaaaaaaaaaaaaaaaaaa

SEQ ID NO: 49876 - DNA, 360 bp, Homo sapiens
  misc_feature 28, 32, 64: n = A,T,C or G
agctctgaaaatctgaggaacattgtantttnaggtttgttaagcatctcttaagtgccatgangagcataacagccggcgtggtggctcacgcctgtaagcccagcactttgggaggccaaggtgggaggatgacaaggtcaggagttcaggaccagcctggccaacatgctgaaacctcacctctactaaaaatacaaaaattggctgggcatggtggcacatgcctgtaatcccagctacttgggaggctgaggcaggagaatcgcttgaacccgggaggcggaggttgcagtgagccaagacagtgccagtgcactgcagcctcggtgacagcgcaaggtccgtctcaataattta

SEQ ID NO: 49877 - DNA, 321 bp, Homo sapiens
  misc_feature 29, 30, 52: n = A,T,C or G
attacctggggaatgggagagcagttcanngtagctacaggctttgaagggngagttgagatatcatttgaaatggacttgaagatcagactaagatgcccagcctttatcctgtggacaatttagagccagtatacatttttgagcaggacttctgatactatcaagatatatctggctgcttatcagtgttggactggataaaggaaatgtggtacatctatactgtggaattccgtgtagccataaaaagaatgaaatcatgtcctttgcagcaacatgaatgcagctggagactgttatcctaagcaaattaagcat

SEQ ID NO: 49878 - DNA, 200 bp, Homo sapiens
tgtcatatgcttcttgcaatggttattttttaatctcaaacggttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaaa

SEQ ID NO: 49879 - DNA, 330 bp, Homo sapiens
ggggtacttgagcccaggaggtgaaggctgcagtgagtcaagattgcaccactgtactccaccctaggcgacagagcaagaacctgtcttcaaaaaaaaaggaattcttagaaatatacaccagatattaccatacatatgaactcatatatagagggttataaacttttgcagatcatttacctgcaacattgttgattttactccatgaattctctattcacattgcatcatagtacacacacctgcaacccaaatataagtaattcctagacagctttgatacatccccagagattttatgtacaattcatccagctaaaaaaaaaa

SEQ ID NO: 49880 - DNA, 220 bp, Homo sapiens
  misc_feature 30: n = A,T,C or G
caatgtttagactgctatggtaatacatantttaaattctaaaagcatacacaatgtgtaactgaatggtttgtgaaaaatatattgatatatatactagttgctgtgaaaatatcatggaataatagggattttagggtggatactttattttcttttatatttctatatgttgcgttgtgatgacattatcttttaaattaaaaagagatttggcaaa

SEQ ID NO: 49881 - DNA, 391 bp, Homo sapiens
  misc_feature 329: n = A,T,C or G
tagaataggtcaaaacactgtaccaatgaaaatgtgtgctcttccaagtagtatatgtgttttattttaatatttagaagatctaaaaagctataggaacacatgttccacttgtaacttaatagcatgccctaaacttaaagatatctttttatggattctgcctctgctgcttctgattaattttgtgacctcaagcaaatctctgaattctttgagccttagggttctcatctgcaaaacgaggataattatacctactcgtagccacaagaatgttgtaaaaatagcagggagaatttttatacagaattagacatgtggtttgnagatttatgggaagcagtcttttgaataaaaattatttagtttgctattattttataataaa

SEQ ID NO: 49882 - DNA, 309 bp, Homo sapiens
tttggtgtggacgttggcctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttgctgtccaccaaatacaattcaaatgctttttgttttatttttttaccaattccaatttcaaaatgtctcaatgggctataataaataaacttcaacactctttatg

SEQ ID NO: 49883 - DNA, 418 bp, Homo sapiens
  misc_feature 52: n = A,T,C or G
acacttctgattaagacggctgaaactagagatggacaggttatcaacgaancttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaacgcaaaaaaaaaaaaaaa

SEQ ID NO: 49884 - DNA, 160 bp, Homo sapiens
tgggaattctagacttttgggaattattcacccctttttagtatactgatttgatgggctttttatatcaatattttttaaattacttaaaacaccctcatgtttattttcgcattagtgtggacctggtcttagaatcttcgccacaaagagcgttcca

SEQ ID NO: 49885 - DNA, 450 bp, Homo sapiens
  misc_feature 26, 27, 62, 85, 86, 380: n = A,T,C or G
aggggcttctgctgagggggcaggcnnttttttgaggaaacccgcagataagtttttttctntttgaaagatagagattaatacnnctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggtgacttaaacagcttaaagnttagtttaaaagttgtagggtgattaaaataatttggaggcgatcttttaaaaagagattaaaccgaagg

SEQ ID NO: 49886 - DNA, 411 bp, Homo sapiens
  misc_feature 43, 77: n = A,T,C or G
caggaacaagcatgtctctctgccaagatccatctaaactggngtgatgttagcagacccagcttagagttcttctntctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaatagggaaagcatatgcagccaaccaagatgcaaatgttttgaaatgatatgaccaaaattttaagtagaaaagtcacccaaacacttctgctttcacttaagtgtctggccgcaatactgtaggaacaagcatgatcttg

SEQ ID NO: 49887 - DNA, 478 bp, Homo sapiens
  misc_feature 256, 270, 291, 325, 335, 337: n = A,T,C or G
ccatatgtatatataacctttattattgctatatctttgtggataatacattcaggtggtgctgggtagatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatgggaaatttcctgccctntggggtccccattnttactattaaagaagaccagngataatttaataatgccaccaactctggttagcnaagtgagagngngactgtgtggcaagagacctcacacctcactaggtgcagagagcccaggccttatgttaaaatcatgcacttgaaaagcaaaccttaatctgcaaagacagcagcaagcattatacggcatcttgaatgatccctttgaaa

SEQ ID NO: 49888 - DNA, 509 bp, Homo sapiens
  misc_feature 185, 358, 381, 450: n = A,T,C or G
gaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtngattcagtattaacagatcttgactacactaattctttatattatagaaccaacggaaatatgggcactattttgaattctagagatggttttggtaaatctactaataaactgtctcttagtagattaagagagagtaatattaattgggcatgggcagttggatttctcantaactgcagtatgcccatttggntttatggctttctaatctaaactgcctgaggaactagataaaagccttgggagattaatactataaatncagggatggcaaggaaccaccctggttttttggggagaatgggcaggggaaactatacc

SEQ ID NO: 49889 - DNA, 354 bp, Homo sapiens
  misc_feature 45, 58, 80: n = A,T,C or G
ccaaaaatgacccccatttgtgtgacttcattgagacacattacntgaatgagcaggngaaagccatcaaagaattgggngaccacgtgaccaacttgcgcaagatgggagcgcccagaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccagaaaaaaaa

SEQ ID NO: 49890 - DNA, 480 bp, Homo sapiens
  misc_feature 29, 78: n = A,T,C or G
cgacatcttgacgaggcttgcaggctgtnttgctagctattcttcgagcttcgcaatgccgcctaaggacgacaaggnagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagcttgctggtgaagatgcatgaataggtcaaccagctgtacatttggaaaaataaaactttattaaa

SEQ ID NO: 49891 - DNA, 192 bp, Homo sapiens
  misc_feature 23: n = A,T,C or G
gggcatatgaaataatgtgtaantagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattatc

SEQ ID NO: 49892 - DNA, 227 bp, Homo sapiens
  misc_feature 123, 207: n = A,T,C or G
gggtgacttcattgagacacattacctgaatgagcaggtgaaagccatcaaagaattgggcgaccacgtgaccaacttgcgcaagatgggagcgcccgaatctggcttggcggaatatctctntgacaagcacaccctgggagacagtgataatgaaagctaagcctcgggctaatttccccatagccgaggggagacttccctggncaccaaggcagtgcatgcat

SEQ ID NO: 49893 - DNA, 408 bp, Homo sapiens
  misc_feature 22, 313: n = A,T,C or G
aggactagcccctataccttcngcataatgaattaactagaaataactttgcaaggagagccaaagctaagacccccgaaaccagacgagctacctaagaacagctaaaagagcacactcgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgnagagagagtaaaaaatttaacacccatagtaggcctaaaagcagccaccaattaagaaagcgtcaagctcaacacccactacctaaaaaatccca

SEQ ID NO: 49894 - DNA, 120 bp, Homo sapiens
acctcgcctgggcccccttctccatatgcctccaaaaacatgtccctggagagtagcctgctcccacactgtcactggatgtcatggggccaataaaatctcctgcaattgtgaaaaaaa

SEQ ID NO: 49895 - DNA, 397 bp, Homo sapiens
  misc_feature 24, 31, 59: n = A,T,C or G
gaatttatcaagtgagcctgtccnagagttntgcacgatagtgatcctgccaacattgngcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgagagaaactattaaaggtattcagaaacgtgaagccagcaattgttcgcaattcggcattttgaaaacaaattgccg

SEQ ID NO: 49896 - DNA, 229 bp, Homo sapiens
  misc_feature 21, 25, 56: n = A,T,C or G
aagctgatagcatatattcanaccngttgtacacttgggtgaaaagtatggcaagngggagactaagatgtattaacctacctgtgaatcatatgttgtaggaaaagctgttcccatgtctaacaggacttgaattcaaagcatgtcaagtggataggtagatctgtggcgatatgagagggatgcagtgcctttccccattcattcctgatggaattgttatactagg

SEQ ID NO: 49897 - DNA, 559 bp, Homo sapiens
  misc_feature 415, 515: n = A,T,C or G
ccatctttccagcctcagtcggacgggcgcaggagacgcttctggaaggaacgccgcgatggctgcgcagggagagccccaggtccagttcaaacttgcattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggcaggagaaattcggtggactgagagatggctattatatccaagcccagtgtgccatcataatgtttgatgtaacatcgagagttacttacaagaatgtgcctaactgcatagagatctggtacgaggtgtgtgaaaacatccccattgtgttgngtgcaacaaagtggatattaaggacaggaaagtgaaggcgaaaatccatggcttccaccgaaagaagaatcttcagtactacgacatttctgccaaaagnaactacactttgaaaagcccttcctcggcttgctaggaagctca

SEQ ID NO: 49898 - DNA, 164 bp, Homo sapiens
acatggccctgggaacagagcgaacattaacaaacagaagccacacagaccaatgggaaagatagggcttattccactaataatgttgagaagttgtctaaacatttggaggaaaataaatgagatcttctttcacactgtacaccaaaataaatttcaaatgg

SEQ ID NO: 49899 - DNA, 344 bp, Homo sapiens
  misc_feature 50, 51: n = A,T,C or G
gcaattcctttggcgctaaagatggcagctgaacaaggaagaatgaaggnnacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcca

SEQ ID NO: 49900 - DNA, 151 bp, Homo sapiens
  misc_feature 37, 49, 57: n = A,T,C or G
attacttccatgaattttaaaatctgagggaaacgtnttgtaaacattnattttttntaaagaaaagatgaaaggcaggcctatttcatcacaagaacacacacatatacacgaatagacatcaaactcaatgctttatttgtaaatttag

SEQ ID NO: 49901 - DNA, 129 bp, Homo sapiens
  misc_feature 17, 58: n = A,T,C or G
agacacacacactgcgngtaggtgtgtgaagtgctacagccactctggaaaacaatgnggccgtatttaacaaagataaatatgcacatactgaatggcccacaagttgtaaaatataccattacaaaa

SEQ ID NO: 49902 - DNA, 442 bp, Homo sapiens
  misc_feature 24, 26, 129: n = A,T,C or G
tcctaagggtgcagcttacggcangngctgtccatcatggtgttaaccagctaaagtttgctcgaagccttcagtccgttgcagaggagcgagctggacgccactgtggggctctgagagtcctgaatncttactgggttggtgaagattccacatacaaattttttgaggttatcctcattgatccattccataaagctatcagaagaaatcctgacacccagtggatcaccaaaccagtccacaagcacagggagatgcgtggctgacatctgcaggccgaaagagccgtgccttggaaagggccacaagttccaccacactattggtggctctcgcggcaagcttggagaaggcgcaatactctccagctccaccgttaccgctaatataagtaaagttgtaaaattcatacttaataaacaatttaaggacaagtcgg

SEQ ID NO: 49903 - DNA, 337 bp, Homo sapiens
  misc_feature 52, 239, 241, 320: n = A,T,C or G
gggacacagttttgaaaacttaagagtaagactttcctgtgtcttaaggacntcaaaattttaaatgcaacctatgcaaatacaaaagagtctttttcatagctttgaaaaattggttgcctctgattcatatgttcatattatattttaaaaagctagtctcatttccagaaacaaaacatacctagtacaaatgaaactgttgtgttgtgaacattaaatatcttgctttgctttgntntctgttttttacattaggcatttgcacaaaagaaggaagcactgtatttgaatgtaaagctccatgaatcttctttgtntttagggtactgaaaat

SEQ ID NO: 49904 - DNA, 187 bp, Homo sapiens
  misc_feature 36, 40, 43, 52, 157: n = A,T,C or G
ataaagaaacagaaagcatatagcaagatggcaggnttanatnacagtaaanataaattatagggatattactacagtataatttatacttatactaattatagtaattatagtaaatacaaatgaactaaccattgcaattcaaaactaatattanaggatcaggcatacctgagaaataggatca

SEQ ID NO: 49905 - DNA, 504 bp, Homo sapiens
  misc_feature 63, 64, 404, 422, 450: n = A,T,C or G
atagctactatgcactcatataaaattaattgctaactaggaagtaatatgaaatatagtatnnggtccaaccttcctggataaactaaattagaggtttaaaggaataaataattaattcttagaatctttttgagaactctgataagatcaaaatgctttttaatgatacgaaaaggaaaatgagtaggtatttaaaaagtaatttgaaactgttgttttttatgttttatttattcattgtacaatattagtacaaattgcacttatgattttaattgtaacagttcagttatggagctaggcaatagacaaaatgttcaagtataactgatgaacttcattaaactagaataaaagtaaagctcaattgtatatactaatagccttgctggaactgtgtnctcaaactggggtttagnaagatattcagaagcaaaaattcccagnggacaaatctgcttgggaaacattgatctaaaacatttatttgaaaaatctgga

SEQ ID NO: 49906 - DNA, 204 bp, Homo sapiens
  misc_feature 34, 81, 104, 127, 132: n = A,T,C or G
gatggccaagatggactacctagcttcagctatnaatctgttcccctgaagctgatgaatttagtttaccatatgcaagtnggtgctacactcagatttgtcanaaaaagtcaatagtgaaatggangccanaagacattgaattggatcctcgcttaagttccaagcgcctacaaaggctagggaaaaccagtaaccatgcga

SEQ ID NO: 49907 - DNA, 492 bp, Homo sapiens
  misc_feature 31: n = A,T,C or G
gaaattctaaaatatttgagaagagccaatnttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatataggaggaaacactatgataaggattcctaaggaat

SEQ ID NO: 49908 - DNA, 222 bp, Homo sapiens
gagggcaggagatcgagaccagcctggacaacatggtaaaagcccatctctaccaaaaattcaaaaactagctgggcgtggtggtgcaccgcctgtaatcccagctacatgggaggctgaggcaggagaatcgcttgaatccaagaggaggaggttgcagtgagccaagatcatgccactgcactccagcctgggagacagaacgagactcccatctcagca

SEQ ID NO: 49909 - DNA, 232 bp, Homo sapiens
caaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaa

SEQ ID NO: 49910 - DNA, 260 bp, Homo sapiens
  misc_feature 68: n = A,T,C or G
aaatttaactccatatgtgtgcctcttgttctaatcttgtgaaccagtgcaagtgaccggcaaaattncagttatttatttccaaaatgtttggaaacagtataatttgacaaagaaaaatgatacttctctttttttgctgctccaccaaatacaattcaaatgctttttgttttatttttttaccaattccaatttcaaaatgtctcaatggtgctataataaataaacttcaacactctttatgatagcgaaaaaga

SEQ ID NO: 49911 - DNA, 236 bp, Homo sapiens
tgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaa

SEQ ID NO: 49912 - DNA, 294 bp, Homo sapiens
tccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcaca

SEQ ID NO: 49913 - DNA, 338 bp, Homo sapiens
  misc_feature 53, 196, 259, 297, 301, 307, 310: n = A,T,C or G
atgactattgaatttaaaactaattatgagttgacaaataaataaaaggtagngtttatgtctgagcttattgtgtttgagctaacaccaggttactcagtaaccatgacctgctcctccatttccatttattctcaacattaaatagttttatcttgttgttgccagaaatgcacttgtgccaggtattgtcccngctgtatgaaaagcttcttggcaatgaattctgtaatagtgccctacattatggttttctggnggaattgtttaacagtgacaacccaggatttccaatanattntggctnatngtattaccaaaaattccactatgatgga

SEQ ID NO: 49914 - DNA, 473 bp, Homo sapiens
  misc_feature 36, 203, 210, 215, 271: n = A,T,C or G
ggccgggaagatggcaggacattcagactgagcgtntctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggnaatgtgnccatncgagggcggatcctctctggcgtggtgaccaagatgaagatgcagaggaccattgncatccgccgagactatccgcactacatccgcaagtacaaccgcttcgagaagcgccacaagaacatgtctgtacacctgtccccctgcttcagggaccgtccagatcggtgacatcgtcacagtggcgaagtgccggctctgacaagacagtgcgcttcaacgtgctcaaggcaccaaggctgccggaccaagaagcaagtt

SEQ ID NO: 49915 - DNA, 517 bp, Homo sapiens
  misc_feature 41, 175, 179, 433, 439: n = A,T,C or G
tcatctttccaatccagaggaacaagcatgtctctctgccnagatccatctaaactggagtgatgttagcagacccagcttagagttcttctttctttcttaagccctttgctctggaggaagttctccagcttcagctcaactcacagcttctccaagcatcaccctgggagtntccngagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgtctgggccgcaatactggaaggaacaagcatgatcttgtactgngatatnttaaatatccacagactcactttttccaaatgatcctagtaattgcctagaaatatctttctctaacctgtaattaat

SEQ ID NO: 49916 - DNA, 368 bp, Homo sapiens
  misc_feature 29, 215, 322: n = A,T,C or G
caatcatctataatgatcaaatttactgnacaatgtgttagtttatccattgtgcttagcttgggtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggnatgccttaagattccttgaatatgtatttactttaaagactggaaaaagctcttcctgtcttttagtaaaacatccatatttcataacctgatgtaaaatatgttgnactgtttccaataggtgaatataaactcagtttatcaatcagaaaa

SEQ ID NO: 49917 - DNA, 486 bp, Homo sapiens
  misc_feature 30, 62, 76: n = A,T,C or G
cgcacattgcctgttctgcttcgaagtatncaataccgctcagtattttaaatgaagtgatnctaagatttggttngggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggataattatggggggtgattattttttatactgatgtgccaaagctttactactgtggaaagacaactgttttaataaaagatttacattccgaa

SEQ ID NO: 49918 - DNA, 428 bp, Homo sapiens
  misc_feature 366: n = A,T,C or G
cagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgatgtgattctaagatttgggntgggatcaataggaaagcatatgcagccaaccaagatgcaaatgtttgaaatgatatgaccc

SEQ ID NO: 49919 - DNA, 239 bp, Homo sapiens
  misc_feature 33, 34, 40, 61, 117, 148: n = A,T,C or G
ataacttcacaaagcatctccattctatcttgnncagctntacatttaaaaataaactctncttgttcatataaaccttatctcttacataaagtgaaatctgctaattttttgttntgacaaggataaactacttacctgcatctgnttaagaatagattaacttattttgagaagaaattctgggcaccatttttgaccattgaagacttatttgtaatggaatttctactttacat

SEQ ID NO: 49920 - DNA, 204 bp, Homo sapiens
  misc_feature 158, 172: n = A,T,C or G
agagatggaagaggtatgggaggcatggctatggtggagctggtgatgcaagttcaggttttcatggtggtcatttcgtacatatgagagggttgccttttcgtgcaactgaaaatgacattgctaatttcttctcaccactaaatccaatacgagtnatattgatattggngctgatggcaggagccacaggagaagcagatg

SEQ ID NO: 49921 - DNA, 460 bp, Homo sapiens
  misc_feature 275, 339, 420: n = A,T,C or G
aattccaaggtgttggggggcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattggctgagggacattccgtttgaaatgtactgaagttacagnttctggtttttctccttatttttcttataatgcttgaaatgtctaactattaaaaaagacaatnggaaaatggtatgcatgggggttttaaagaaaacaaagggtctttttattgactgacaattcattttacactctatataanaaaatctccacaaggcatcttggggggcaaaggcaaaaaa

SEQ ID NO: 49922 - DNA, 219 bp, Homo sapiens
aagaaatacatgctatatttattcaagtgtctattgcttaattggtaattgtgagcagatttattgaatgcctattctattttctgcagtttacaatacaataactctttgagtaaggttgaagtttaattgtgcaacaaatttgtattagagtacaatttaaagtgtttttctctatagccttttttgactggggaagcaaggggtaatggtaattag

SEQ ID NO: 49923 - DNA, 309 bp, Homo sapiens
cagaatatgccttccgcatgtctcgtctcagtgcccggctatttggtgaagtcaccaggcctactaattccaagtctatgaaagtggtgaaactgtttagtgaactgcccttgccaagaagaaggagacttatgattggtatccaaatcaccacacttacgctgaactcatgcagacgctccgatttcttggactctacagagatgagcatcaggattttatggatgagcaaaaacgactaaagaagcttcggggaaaggagaaccaaagaaaggagaagggaaaagagcagcaaaaaggaaatagtgt

SEQ ID NO: 49924 - DNA, 319 bp, Homo sapiens
aaattcgataagtcgaaactgaagaagacagagacgcaagagaaaaatccactgcttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaactttgc

SEQ ID NO: 49925 - DNA, 314 bp, Homo sapiens
  misc_feature 123, 132, 209, 239: n = A,T,C or G
ccatggcaaccataacttttgaccaaaaaaaattgtttttacatctttatgctgaaaatgtgtttagattaggaatatggccggctgaatttgctgttgctccctaccaaatccacctcttgntttccttgngagccatggctaaatcaaagctgccctgagaagagcttaatccaagcctgatgtactagtggcatcacttagaagangctttccctcttcctagtagatctcaatgnttataattccttaaacagctgaaaattgggacaacatactttacgcatggacagagtaaataggaataaactagt

SEQ ID NO: 49926 - DNA, 147 bp, Homo sapiens
gagacagttatactttcaactgccattatttttattaagtgctttcattttctttacagttattataaaattgtatttattttatacagatgggttttcattttcctgatgctgtaatgtttacttcagcttgttgacctttctttg

SEQ ID NO: 49927 - DNA, 272 bp, Homo sapiens
aaggaaaggagacatctcagcaaggaattttgaaaagcacccaaaagccaaattgggatggtatcacagagtggcaaaaaatgagacctgtcaagtcactgatctatacagctggtgtcacttgctgaataatctctattctttggagaaccatgaatgtagttttctcagaaaatgaaaagaaatgacaaatacataacattaataatttggataataaaaatgtaatgtacataagaattataatcagcaagaaaatttatacgccaaat

SEQ ID NO: 49928 - DNA, 356 bp, Homo sapiens
atctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcatttcgagaagcactggagattactggaaagtatgaaagcacagtatgttgctgggaatggttttcgaaaagtgtcctgtgtgttaagctcaaatcttcgtcatgtgagagtatttgaaatggacatagatgatgaatggga

SEQ ID NO: 49929 - DNA, 373 bp, Homo sapiens
aaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggctgtcatataaaacatactgtcattgagcttaagctccgcttgtctgaggtttcacctccatgtgtttcattggtgcaaaagtggatctcttagttggcacttaattctttcttttcagaaagatagtatgtcactggtatatttggcactcttagaaccttccttcacattgtttttatgggacccatgaatgggtagcctt

SEQ ID NO: 49930 - DNA, 169 bp, Homo sapiens
ctcatttccaaagacccagagtctcagagccaggttaagtggaagaaactttgagaggtttcttaatcaattccttctatctctcaaaccatgccagtaacttccttggtgaaaaaatctatactcctgtcacaggcttcgggcatggaaattctatagcattctttgg

SEQ ID NO: 49931 - DNA, 337 bp, Homo sapiens
cacgtttggtttggagagtccatggatggtgggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagtctggaggatggttgcacgaaacacactggggaatggagcaaaacagtctttgaatatcgaacacgcaaggctg

SEQ ID NO: 49932 - DNA, 206 bp, Homo sapiens
attgtgataatagagaattttatttatttttatgccagcttatattgtgagaacacatttagtcagtttgggttttatcaatcctgttaatgcttgccttggaacatctttcgcgtattcacggtttgtagttgaaaagtttactgtaaaaaaatcaaaaacaaaaaaatgtattgtttttacagaataaatttattggaatgtga

SEQ ID NO: 49933 - DNA, 132 bp, Homo sapiens
ataaaaacagtcaatatttgacaatgtggaattaccaaattaaaagagaatactatgaatggattcatatttttttctatattgaataaacaatgtaacatagataacaatataaataaaagtggtatgacc

SEQ ID NO: 49934 - DNA, 323 bp, Homo sapiens
gaagaagccactgaaacagcccaagaagcaggccaaggagatggacgagataaggctttcaagcagaaacaaaaagaggagcagaagaaactcgaggagctaaaagcgaaggccgcggggaaggggcccttgccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttggaaaaaaaaaa

SEQ ID NO: 49935 - DNA, 325 bp, Homo sapiens
  misc_feature 39, 276: n = A,T,C or G
tataatccttaaatcttaatgttcctcaaagcttggatnaaatacatatggatgttactctcttgcaccaaattatcttgatacattcaaatttgtctggttaaaaaataggtggtagatattggggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgnttaataagctactagcaaaataaaacatagcaaatgccaaaaaaaaaaa

SEQ ID NO: 49936 - DNA, 336 bp, Homo sapiens
tctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttctgaatgagaaacatgagggaaattgtggagttagcctcctgtggtaagggaattgaagaaaatataacaccttacaccctttttcatcttgacattaaaagtctggctaactttggaatccattagagaaaaatccttgtcaccagattcattacaattcaaatcgaagagttg

SEQ ID NO: 49937 - DNA, 307 bp, Homo sapiens
  misc_feature 43: n = A,T,C or G
agaggtcttctttctttcttaagccctttgctctggaggaagntctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaag

SEQ ID NO: 49938 - DNA, 247 bp, Homo sapiens
tgtgggagaaataaatgctcatgtagaaaagcatggcgcatgtgagagacgagacagcaggaaaggaggcaggggatgtgaattacaggctctaatgagaagcagctgtgtgactctgggccagtcattgaaactgtgagacttaattttttccatctgtaaaacacaggctcaatctattcaaatgaatatttagggagtactatgtacccagtacttttttaggcactgagaaaaatatcagtaa

SEQ ID NO: 49939 - DNA, 289 bp, Homo sapiens
cccctttcacatcaaagaactactgacaacgaaggccgcgcctgcctttcccatctgtctatctatctggctggcagggaaggaaagaacttgcatgttggtgaaggaagaagtggggtggaagaagtggggtgggaccgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaa

SEQ ID NO: 49940 - DNA, 254 bp, Homo sapiens
gtacttaagtcattccatctttcactcatgatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggccttttgcaataaaactggttatgacttgatccaagtgttt

SEQ ID NO: 49941 - DNA, 165 bp, Homo sapiens
ggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaa

SEQ ID NO: 49942 - DNA, 198 bp, Homo sapiens
taccagcaatctctctttctcctaagaatgtcatgccttctcaagacctgatgaaaggaataagatatttgtgcctttttataaaagcatctattacgaaagtaaaattcagttgcttacagttttggccgctttgtagcactattataaacagcccaaatttatggccttggacttactgcatgacacatggcctgg

SEQ ID NO: 49943 - DNA, 325 bp, Homo sapiens
tttttctttcactttttaaatgtctttgttaaaagctaagacacaaacccaatcattagcctacaccacacaggttaagaatcatcaatattactgccttccacctccacatcttgtctcactggaaggtctctgacctgcttggagcagtcatctcctatgataacaataccttctgttgggatacctcctgaaggacctgcctgaagcttttttacagtataccttttttaacaagcggaaagagtaaactctaaaatgacaaaatgtgagtatagtaaatacataaacctgtaacatgggaattaattatcattatcaagta

SEQ ID NO: 49944 - DNA, 240 bp, Homo sapiens
cagaaatacttagtacactccacctgttctttgatgggaatatctaagaaggctaggtaggttcttagggttagcctgagtcatctaggggctcaactccttgtgaggggaaatgacagtgaacaagttaagtactttgctccacaaatgcatgaaaggacaaatttgcatcttctatcagtatttaacttccttttgctaatgacaaataaatatatctatatttataaaaaaaaaaaa

SEQ ID NO: 49945 - DNA, 295 bp, Homo sapiens
  misc_feature 10: n = A,T,C or G
gagacaaagnccgttcctagtaaagtggcttccacagacaaagacaggaaaggaagaggctcctccagccatgctccagtcacaaaggaaaatagccagaagagaaagaactgaaggcccatcgttaacacccagcaatgggtgaccttcctgactccgatttgctgctaaagggcagaggaaatccgggattactcgggctggggaaatgctacatattaaccactgaatgtgtttattggtgctcaataagtaacttctgtgaaacaagcattctttgtcatctcggtttcca

SEQ ID NO: 49946 - DNA, 342 bp, Homo sapiens
gatgatgaaagtcttcttggacacttaatgattgttggcaagaaatgtgctgctgatctgggcctgaataagggttatctgaatggtggtgaatgaaggttcagatggtggacagtctgtctatcacgttcatctccatgttcttggaggtcggcaaatgcattggcctcctggtaagcacgttttggggataattttctcttctttaggcaatgattaagttaggcaatttccagtatgttaagtaacacacttatttttgcctgtgtatggagagattcaagaaataattttaaaaccgcatacataataaaagacattggtgcatggcgaaaaaaaaaa

SEQ ID NO: 49947 - DNA, 310 bp, Homo sapiens
  misc_feature 172, 174, 179, 186, 256: n = A,T,C or G
ttctgcaagatcctggggccattatcctactccaagatcaagcatttgcgtttggatggcaatcgcatctcagaaaccagtcttccaccggatatgtatgaatgtctacgtgttgctaacgaagcactcttaattaatatctgtatcctggaacaatattttatggtatgtntntctgngggcagntttcatagtatccatattttattactggttattacttccatgaattttaaaatctgagggaaatgtttgnaaacatttatttttttaaagaaaagatgaaaggcagcctatttcatcacaagac

SEQ ID NO: 49948 - DNA, 316 bp, Homo sapiens
agggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatgggctgttgccaccatgtattcatccagagttcttaaagtttaaagttgcacatgattgtataagcatgctttctttgagttttaaattatgtataaacataagttgcatttagaaatcaagcataaatcacttcaactgctaaa

SEQ ID NO: 49949 - DNA, 154 bp, Homo sapiens
tacttcaaattcctccctgtacgaaaggacaagagaaataaggcctacttcacaaagcgccttcccccgtaaatgatatcatctcaacttagtattatacccacacccacccaagaacagggtctaaaaaaaaaaaaaaaaaaaaaaaaaaaaa

SEQ ID NO: 49950 - DNA, 323 bp, Homo sapiens
ggctgagatcgagaaattcgataagtcgaaactgaagaagacagagacgcaagagaaaaatccactgccttccaaagaaacgattgaacaggagaagcaagcaggcgaatcgtaatgaggcgtgcgccggcaatatgcactgtacattccacaagcattgcttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaa

SEQ ID NO: 49951 - DNA, 192 bp, Homo sapiens
cccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatgg

SEQ ID NO: 49952 - DNA, 269 bp, Homo sapiens
  misc_feature 160: n = A,T,C or G
gaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttactngtaactttctgggtatatactgcttatatctgtggattcaaggtactgaagtgaataccaataaaaagaaaaccctaggccatggtaattggtatcatgttggaatgct

SEQ ID NO: 49953 - DNA, 164 bp, Homo sapiens
gactgaatcagcagttgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcaaa

SEQ ID NO: 49954 - DNA, 178 bp, Homo sapiens
ggcatttgtagctcccggctactgagcacctgctggatgctcgctctggcccaggtacctccctggagaggctcatggactttttacagtgtccctaaggagtgggcactttgaggaacccagtttacagatggggaaactgaggctcagagaaaagggttaaccagcccaaggtcct

SEQ ID NO: 49955 - DNA, 172 bp, Homo sapiens
tatgccttttttaaagtagttttctttaggaactgtcagcatgttgttgttgaagtgtggagttgtaactctgcgtggctatggacagtcaacaatatgtacttaaaagttgcactattgcaaaacgggtgtattatccaggtactcgtacactatttttttgtactgctgg

SEQ ID NO: 49956 - DNA, 372 bp, Homo sapiens
  misc_feature 59: n = A,T,C or G
acaaccctctctcctcagcgcttcttctttcttggtttgatcctgactgctgtcatggngtgccctctggagaaggccctggatgtgatggtgtccaccttccacaagtactcgggcaaagagggtgacaagttcaagctcaacaagtcagaactaaaggagctgctgacccgggagctgccagcttcttggggaaaaggacagatgaagctgctttccagaagctgatgagcaacttggacaagcaacagggacaacgaggtggacttccaagagtactgggcttcctgtcctgcatcgcatgatgtggaacgaattctttgaaggcttcccagataagcaggccaggaagaaatgaaaactcctctgatg

SEQ ID NO: 49957 - DNA, 307 bp, Homo sapiens
tctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggataggatgtagcctatagatgtgtcattttaataagttgggat

SEQ ID NO: 49958 - DNA, 347 bp, Homo sapiens
  misc_feature 161, 254, 291: n = A,T,C or G
tcatgaccaaccgactacttcagaggaaacaaatggtcattgatgtccttcaccccgggaaggcgacagtacctaagacagaaattcgggaaaaactagccaaaatgtacaagaccacaccggatgtcatctttgtatttggattcagaactcattttggnggtgcaagacaactggctttggcatgatttatgattccctggattatgcaaagaaaaatgaacccaaacatagacttgcaagacatggcctgnatgagaagaaaaagacctcaagaaagcaacgaaaggnacgcaagaacagaatgaagaaagtcagggggactgcaaaggccaatgttggtgctg

SEQ ID NO: 49959 - DNA, 302 bp, Homo sapiens
ggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagc

SEQ ID NO: 49960 - DNA, 314 bp, Homo sapiens
  misc_feature 232, 242: n = A,T,C or G
ggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtataagtaggaaatgtaagtggggtggcttatggcttctttatcctctgattctagcactttcaagtgagctggtgcgtactgnatcatattgnagctattaagggaagagaagaatgttgcttaagaaagaacatcaccattgattttaaatacaagtagcaggg

SEQ ID NO: 49961 - DNA, 356 bp, Homo sapiens
cttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgccaaaagacgttttctttggaccaaagatctctttcgtgattccttgcaacaatcaatgagaatcttcatgtattctggagacaccattcctgatttcccacaaactgcactacatcagtataactgcatttcta

SEQ ID NO: 49962 - DNA, 356 bp, Homo sapiens
  misc_feature 45, 46, 47, 49: n = A,T,C or G
gagccggatccttcttgccatcctggccgccttagcggaagaacnnngngttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggccaaatgagactgagggaagaaaaaaaatctctttttttctggagctggcacctgatttg

SEQ ID NO: 49963 - DNA, 316 bp, Homo sapiens
aaatcattctgttaaccaccattccaacaggtcgaggagagcttaaacaccttcttcctctgccttgattctcttttattttttattttttcgcatcagtattaatgtttttgcatactttgcatctttattcaaaagtgtaaactttctttgtcaatctatggacatgcccatatatgaaggagatgggtgggtcaaaaaagggatatcaaatgaagtgataggggtcacaatggggaaattgaagtggtgcataacattgccaaaatagtgtgccactagaaatggtgtaaaggctgtcttttttttttttttt

SEQ ID NO: 49964 - DNA, 332 bp, Homo sapiens
  misc_feature 205: n = A,T,C or G
cgcgacgttcgcccgctcgctctgaggctcctgaagccgaaaccagctagactttcctccttcccgcctgcctgtagcggcgttgttgccactccgcaccatgttcgaggcgcgcctggccagggctccatcctcaagaaggtgttggaggcactcaaggacctcatcaacgaggcctgctgggatattaagctccagcgggtgnaaacctgcagagcatggactcgtccacgtctctttggtgcaagctcaccctgcggtctgagggcttcgacacctaccgctgcgaccgcaacctggccatggcgtgaacctcaccagtatgtccaaaa

SEQ ID NO: 49965 - DNA, 352 bp, Homo sapiens
gacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcaggttttcagg

SEQ ID NO: 49966 - DNA, 334 bp, Homo sapiens
cgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgcccctttcacatcaaagaactactgacaacgaaggccgcgcctgc

SEQ ID NO: 49967 - DNA, 305 bp, Homo sapiens
  misc_feature 295: n = A,T,C or G
aggtcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtgatgcccaaagattctcacaggtctttatggaggaaccaaggggcctgcacacccttcagatgcccaactcacgggcacattagaggtggcctttccagcacgcatttttaataaagtgacggncaaaaaaaaa

SEQ ID NO: 49968 - DNA, 151 bp, Homo sapiens
gatacttctctttttttgctgttccaccaaatacaattcaaatgctttttgttttatttttttaccaattccaatttcaaaatgtctcaatggtgctataataaataaacttcaacactctttatgataaaaaaaaaaaaaaaaaaaaaaa

SEQ ID NO: 49969 - DNA, 312 bp, Homo sapiens
cctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataggaagagaaagggccaagtgatccagttctaagtg

SEQ ID NO: 49970 - DNA, 320 bp, Homo sapiens
gaagaacattgatgatggcacctcagatcgccctacagccatgctctggtggctggaattgaccgctacccccgcaaagtgacagctgccatgggcaagaagaagatcgcaagagatcaaagataaaatcttttgtgaaagtgtataactacaatcacctaatgcccacaaggtactctgtggatatccccttggacaaaactgtcgcaataaggatgcttcagagatcctgctcttaaacgcaaggccgacgggaggccaaggtcaagtttgaagagagatcaagacaggcaagaacaagtggttcttccagaaactgc

SEQ ID NO: 49971 - DNA, 133 bp, Homo sapiens
  misc_feature 48, 101: n = A,T,C or G
gggatgcagagaagaaagaacggagtgaagccatttatgcctacggcncagaaagggatgaaatcttgagagcagtgggaaatatgccctattgaatgttngcattaaaagtgtttatataacttaaaaaaaa

SEQ ID NO: 49972 - DNA, 307 bp, Homo sapiens
agagccaagtggaggaagaagcgaatgcggaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggcctctgccctggacctgtgacattctggactatttctg

SEQ ID NO: 49973 - DNA, 332 bp, Homo sapiens
  misc_feature 52: n = A,T,C or G
aaactctaaatgcatggcaactgttaatgtcataacagtttagttattttgntctgttctgtcatgtgccacaaaatatgtacttttttcacttttttccctttgtatatcagttacgggttacaactggtcattctgaaaacaacaacaacaaaagtccattcatattttttaacaattgtataagtgcccaagtaattcactacagcctaaagccttgctttgtaatttgacttctgacatgttggcaatcaaagcatgcacttgtaacaatgaaaaagaaaaagcattttatattactactcaataaaatgtgcatgaacttacagaat

SEQ ID NO: 49974 - DNA, 259 bp, Homo sapiens
  misc_feature 206, 247: n = A,T,C or G
tttaaatgactgtgctgcccctttcacatcaaagaactactgacaacgaaggccgcgcctgctttcccatctgtctatctatctggctggcagggaaggaaagaacttgcatgttggtgaaggaagaagtggggtggaagaagtggggtgggacgacagtgaaatctagagtaaaaccaagctggcccaaggtgcctgcaggctgnaatgcagtttaatcagagtgccattttttttttgggcaaangattttaattat

SEQ ID NO: 49975 - DNA, 155 bp, Homo sapiens
tgtctctgtagaaaacctcataaactctaaccctaacttcaagactcaacttaaatgccactttctctgtgaaaatggaaactttccccctcaatcagagtgcgtcagggtcctttcttcttcctttttttaaaaaaaaaaaaaaaaaaaaaaaa

SEQ ID NO: 49976 - DNA, 247 bp, Homo sapiens
tggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaaaaaaaaa

SEQ ID NO: 49977 - DNA, 330 bp, Homo sapiens
  misc_feature 67, 72, 73, 205: n = A,T,C or G
ctggaggctatccagcgtactccaaagattcaggtttactcacgtcatccagcagagaatggaaagncaaanntcctgaattgctatgtgtctgggtttcatccatccgacattgaagttgacttactgaagaatggagagagaattgaaaaagtggagcattcagacttgtctttcagcaaggactggtctttctatctcttgnactacactgaattcacccccactgaaaaagatgagtatgcctgccgtgtgaaccatgtgactttgtcacagcccaagataggtaagtgggatcgagacatgtaagcagcatcatggaggtttgaa

SEQ ID NO: 49978 - DNA, 308 bp, Homo sapiens
attggaaggtaaataaatacattctcagtcctagcaaaactgctggaaaagaattagcaaaggtttgagataagaaaagtgataccagaaggaaacttagaacatcatcaatgaaggaacaaaagcagaaatagaaaatgtctgggtagacataacagactattattcttctcttgagttccttaaggtatgtttgatggtgaaagcaaaaattgtaactttatctgatgcagttgtcattgtatctagatgtactacatacataagataaaagggtaaatgtaatgggactaactcttgatgaagtt

SEQ ID NO: 49979 - DNA, 222 bp, Homo sapiens
gagcctggtgatagctggttgtccaagatagaatcttagttcaactttaaatttgcccacagaaccctctaaatccccttgtaaatttaactgttagtccaaagaggaacagctctttggacactagaaaaaaaccttgtagagagagtaaaaaatttaacacccatagtaggcctaaaagcagccaccaattaagaaagcgttcaagctcaacacccacaa

SEQ ID NO: 49980 - DNA, 354 bp, Homo sapiens
ggcacagaggagctcccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggcatactaattgatcaagggaaagatgaccagtttcttttagatggcaggtacttcctgataacttcatagctgc

SEQ ID NO: 49981 - DNA, 207 bp, Homo sapiens
gccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatat

SEQ ID NO: 49982 - DNA, 353 bp, Homo sapiens
ttaggctacagtgtctcgatgccataatcagaacacactttttttcctctttctcccagcttcaaatgcaaattcatcattgggctcacttctaataactgtagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagccactatgaaaccacgacaaaaaaaaaaaaaaaaaaaaaaaaa

SEQ ID NO: 49983 - DNA, 157 bp, Homo sapiens
tgctgatggccagactctgtttgctggctacacggacaacctggtgcgagtgtggcaggtgaccattggcacacgctagaagtttatggcagagctttacaaataaaaaaaaaactggcttttctggaaaaaaaaaaaaaaaaaaaaaaaaaaaaaa

SEQ ID NO: 49984 - DNA, 138 bp, Homo sapiens
tttaaaaatatttattaatgtgaatggaatataacaattcagcttaattccccaaccttattctgtgtgtagacattgtattccacaattttgaatggctgtgttttacctctaaataaatgaattcagagaaagtga

SEQ ID NO: 49985 - DNA, 309 bp, Homo sapiens
ggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagcattctctgggtatataatatgattttgactaccttatctgg

SEQ ID NO: 49986 - DNA, 424 bp, Homo sapiens
ggaaggagctgaggaagaagacagactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcgccttaaatttgctgttgaagaaattatacaaaaacaagttaaggtgaactgcacagctgaagtactttacccttcaacgggacaagaaactgcaccagaagtcaacttcacatttg

SEQ ID NO: 49987 - DNA, 323 bp, Homo sapiens
aaaacataaaggcccacagcaccattaatatccttgagaaagtggtaagcattatataaatacatttttgcatcctttatatataggttactatattctgggtaagtagagttattgtcagactgcatgcaaataacaggagtgtggggataagtggccttggctgtattttgtactgatcggcttgtgtattatctctgaatcacctgctaccttggcattctttcagtagtgcacataagccatcctcagcaccttgatcttatattagcttacaaacagatttgacttcataggtagagcagtataaaataaccatatgt

SEQ ID NO: 49988 - DNA, 165 bp, Homo sapiens
aacatgctttaatcaggcacggtggttcatgcctataaccctagccctttgggagaccaaggcaggaggatcccttgggcctaggacttcaagacctgcctgggcaacataacgagatcttgtctctacaaaaaaagaaaaaaaaaaaaatttaacaaattagcc

SEQ ID NO: 49989 - DNA, 246 bp, Homo sapiens
  misc_feature 143: n = A,T,C or G
gggtaacccttctgttatttaaagatgtaaaaaatgcgggagacttgagaagaaaggcatggaaggcaccatcgatggatcactgataaatcctacagtgattgttgatccatttcagatcttgtggcagcaaacaaagcagntcacctctacaaactgggaaaaatgaagacaaagaactctatctactgaaattattttcaacctttccccaaataacaatatttcagaggctttgaaaaaatt

SEQ ID NO: 49990 - DNA, 384 bp, Homo sapiens
gaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggtctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaactcaatagattccttcttctg

SEQ ID NO: 49991 - DNA, 159 bp, Homo sapiens
  misc_feature 35: n = A,T,C or G
cctgacactaaggaaatgctgaagcttttggactncggcagtctgtccaaccttcaggtcactcagcctacagttgggatgaatttcaaaacgcctcggggacctgtttgaattttttctgtagtgctgtattattttcaataaatctgggacaacata

SEQ ID NO: 49992 - DNA, 358 bp, Homo sapiens
cttcaagcgttgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggtccctcaagtccaagcttttgttaggagtgataaacccaaactgttcagaggactgcaaatcaagtatgtcccggggtcagaccctgtattaaagcttttggacgcaatggaacattgctgaagactgagcat

SEQ ID NO: 49993 - DNA, 306 bp, Homo sapiens
  misc_feature 248: n = A,T,C or G
ggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggngacaaaactttttatatcaaaaggctttgcacatttctatatgagtggggtttactgg

SEQ ID NO: 49994 - DNA, 169 bp, Homo sapiens
  misc_feature 35, 38: n = A,T,C or G
gcagcattactgaaatacataggcttatatacaangcntctttcctgtatattctcttgtctggctgcacccctttttcccgcccccagattgataagtaatgaaagtgcactgcaagtgagggcaaaggagagtcaacatatgtgattgttccataataaacttctgg

SEQ ID NO: 49995 - DNA, 279 bp, Homo sapiens
aagaatcatgtacagagcttaaatgtaatttatatgtttttaatatgccattttcattgaagtattttggtcttaagatgactttagtaatttaactgtttatgttacccacgttgggatccagttggcttggtttgcttctctctgtaccacgtgcacatgaggccattcattttacagcccctgttacacacagacccacaggcagccgctgtgccccgcacacattggtggcctatttgtaaatcccacacccggtgtatccaataaagtgaaaca

SEQ ID NO: 49996 - DNA, 277 bp, Homo sapiens
caaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgctttacctgatttgatgatacatttcattaa

SEQ ID NO: 49997 - DNA, 317 bp, Homo sapiens
atagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttagtccaaagaggaacagctctttggacactaggaaaaaaccttg

SEQ ID NO: 49998 - DNA, 307 bp, Homo sapiens
ttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatggttctctttgattatttgcatgttatgtttaataagctactagcaaaataaaacatagcaaatggct

SEQ ID NO: 49999 - DNA, 310 bp, Homo sapiens
ggatacataacctgaggagccgggggaagctggccttggggaaatctaccactgtcgaagacaaataaaatatagcaaagacaagatgtggtatttggcaaaattgatacgaggaatgtctattgaccaggctttgctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatgcagagg

SEQ ID NO: 50000 - DNA, 407 bp, Homo sapiens
  misc_feature 86: n = A,T,C or G
attaaagacggcccacagaccagaacttccactatactacttaaaattacataggtggcttggcaaattcaattgattagtattgnaaaaggaaaaagaagtccttcttacagcttggattcaacggccaaaacaaaaatgcagctgcattaaagtcacagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctagg

SEQ ID NO: 50001 - DNA, 303 bp, Homo sapiens
  misc_feature 31: n = A,T,C or G
tgagaataaaaaatatagtgttgagatccgnacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggt

SEQ ID NO: 50002 - DNA, 421 bp, Homo sapiens
  misc_feature 399: n = A,T,C or G
ggcataacttctgatgctaatgttctgactaatgaactattgctcattgctcaaaggtatttattacagtatcaggagccaataccttgtgagcagttggttacagcgctgtgtgatatcaaacaagcttatacgcaatttggaggaaaacgtccctttggtgtttcattgctgtacattggctgggataagcactatggctttcagctctatcagagtgaccctagtggaaattacgggggatggaaggcacatgcattggaaataatagcgctggcagctgtgcaatgttgaaacaagactataaagaaggagaaatgaccttgaagcagcacttgctttagctatcaaagtactaaataagaccatggatgttaggaaactctctgctgaaaaagnggaaatgcaacactaacaagaa

SEQ ID NO: 50003 - DNA, 384 bp, Homo sapiens
cagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggcatcggtggtgctgaccaggaattctttgtggacattggcccagtctgtt

SEQ ID NO: 50004 - DNA, 202 bp, Homo sapiens
accgaccagtgaagctcttacagtgcgtggaccacagcacccatcctgactgtgccttaaagtccgaggaagccgaaatctccagaggctctggcaagagttgagtcaattgcatgcctgcctagtccagctccgtccacatgaatgctctccacaagcttcagaggaaacaggataaaatggactcccaaaaaaaaaaaaa

SEQ ID NO: 50005 - DNA, 326 bp, Homo sapiens
agtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcagcaaaacaaatgtaatgttgcagatccgcagcagaagctctgcccttctgtatcctatgtatgcagtgtgctttttcttgccagcttgggccattcttgcttagacagtcagcatttgtctcctcctttaactgag

SEQ ID NO: 50006 - DNA, 333 bp, Homo sapiens
  misc_feature 68: n = A,T,C or G
attacttaaatatgctcagaaaagcagtggtaaacagctatttaggaattgaggctgttactcctgcntccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgactgtttttcagtatttggggagggtggtttgagcagcatttattgacaatttcattagtggggatggttctattgaaaacagagt

SEQ ID NO: 50007 - DNA, 227 bp, Homo sapiens
ccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagccaaaaaaaaaaaa

SEQ ID NO: 50008 - DNA, 345 bp, Homo sapiens
ttgctgggaaacagctggaagatggacgcaccctgcctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaagg

SEQ ID NO: 50009 - DNA, 333 bp, Homo sapiens
gagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggacggcataataataacatgatggccaaaactttggaagagtgtagag

SEQ ID NO: 50010 - DNA, 311 bp, Homo sapiens
acacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctttacacctgtccccctgcttcagggacgtccagatcggtgacatcgccacagtggcgagtgccggctctgagcaagacagtgcgcttcaacgtgctcaaggtcaccaaggctgccg

SEQ ID NO: 50011 - DNA, 147 bp, Homo sapiens
  misc_feature 54: n = A,T,C or G
tctctgagagtaagacaagaaagctttgtaaatggcgttgaatttcctgctctnggcaggccctgtcagcacagaagaaaagactgatcaagttgtccaagatggagccctttatccacgttagtccacttatctctttaagattaa

SEQ ID NO: 50012 - DNA, 283 bp, Homo sapiens
gagccgagatcgtaccactgcactccagcctgggcgacatagcgagactccgtctcaaaagaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttg

SEQ ID NO: 50013 - DNA, 397 bp, Homo sapiens
catgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctggttaactttgtaagatgcaaagaggttggatcaagtttaaatgactgtgctgcccctttcacatcaaagaactactgacaacgaagccgcgcctgctttcccatctgtctatctatctggctggcaagggaaggaaagaacttgcatgttggtgaaggaagaagtggggtggaagaagtggggtgggacg

SEQ ID NO: 50014 - DNA, 349 bp, Homo sapiens
  misc_feature 12: n = A,T,C or G
gatatgacccanaagccattgtaaagtgccacattaccaaaattaattaaggaaactttatagcctgcgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattgggctattgaaacaaacaatacaattaaaagcactaaagattattata

SEQ ID NO: 50015 - DNA, 283 bp, Homo sapiens
cagaggaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttaaaaaaaaaaaa

SEQ ID NO: 50016 - DNA, 310 bp, Homo sapiens
taatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagtggcctcttcttcagattcagcatttgtctttgccagctcattttcatcttcttccatggttccacagaagccttggttcttggcaagcagaaaaattaaatgtacctatttggatatgggaga

SEQ ID NO: 50017 - DNA, 288 bp, Homo sapiens
gaagttaccctttaagtaactgaaattacagaagtaaaaatattattttctatttttagtgtcagtaaattaaaattgttacatattataattaaaaattatatgtataaggtattgattttaaaatacatttttaatcctgcagctgatgggtacaatgaaaatggtagtttccaacattgctagtagtagcataagttgatgtagacctttggaaaaaaacagttggctatgtttcagaagtcaaaaataagctgtaacctttgcccagtaatcctatttctggag

SEQ ID NO: 50018 - DNA, 329 bp, Homo sapiens
  misc_feature 70, 71, 246: n = A,T,C or G
agaactcttttggcataaatatttgtgttcccagtacctcacttgttcggatttgactgcctgtatatgnnttgtgaaatggtcctgtttttgggtaaggtgacacgtggactctagtatgtaaatgttacttgaatctgtgcttcataataagtgtgtggcatgtatgtgcagactcttggatgctttatgcctgcgcaggaggagccctgcctcacgttcccaggaggcggcttcacccttcgnaaccaggagacaagcggcatggattgcccttgattctattttgctaatggaagaaagaaaggagagaaggttttttttttttt

SEQ ID NO: 50019 - DNA, 200 bp, Homo sapiens
agatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactca

SEQ ID NO: 50020 - DNA, 116 bp, Homo sapiens
agttctctcatttccaaaccatcgctgcttttaaaataagatctctttgtagccatcctgttaaatttgtaaacaatctaattaaatggcatcagcactttaaccaaaaaaaaaaa

SEQ ID NO: 50021 - DNA, 401 bp, Homo sapiens
ggcatactttataggacccattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgcagcatgagtatctatgacgatattgatgctgacgtgctgcaaaattaccaagaatacaatctggccaacatcatctactactctctgaaggagccaccactagtgagcagagtgccaggatgacagccatggacaatgccagcaagaatgctctgagatgatgacaaattgacattg

SEQ ID NO: 50022 - DNA, 425 bp, Homo sapiens
tcagctgtctcttacttttaaccagtgaaattgacctgcccgtgaagaggcgggcataacacagcagggacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccagcggaacaagttaccctagggataacagcgcaatcctattctagagtccatatcaacaatagggtttacgacctcgatgttggatcaggacatcccaatggtgcagccgctattaaaggttcgttgtcaacgattaaagtcctacgtgatctgagttca

SEQ ID NO: 50023 - DNA, 439 bp, Homo sapiens
  misc_feature 37, 70: n = A,T,C or G
ctcattgcagataatttttagcttagggcctggtggntaggtcgggttctctcctttccagtcggagacntctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggcttccagaagccacatccgacaattttccacttaaccaggaaatatttctcctctaaatgcatgaaatcatgt

SEQ ID NO: 50024 - DNA, 302 bp, Homo sapiens
ataggtcctttagaaacacataattaacacttaaggtggggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcaagccatcaactaaaggtggactttctgttaaaatgcatgattgcagaattggtta

SEQ ID NO: 50025 - DNA, 252 bp, Homo sapiens
tatgattttctttaaggatgggttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactca

SEQ ID NO: 50026 - DNA, 190 bp, Homo sapiens
cacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaa

SEQ ID NO: 50027 - DNA, 338 bp, Homo sapiens
aagaagaaaaaccaagagaattccaccgactcccaggagagcatttcaagattgaggggataggtgttgtgttgaattttgcagccttgagaatcaagggccagaacacagcttttagatttagcaacaaggagtttggtgatctcagtgaaagcagcttgatgggtgaaatggaggcagagcagattgcaatgagtgaaacaagtgaatggaaagtgaagaaatgatacagataattcttgctaaaagcttgctgttaaaaggaggagagaaacaagactagctgcaaagtgagattgggttgatggagcagttttaaatctcaaaataaagagctt

SEQ ID NO: 50028 - DNA, 380 bp, Homo sapiens
  misc_feature 41, 52: n = A,T,C or G
acataaattacaaaatctgaagccctttaagcagcattaanactgctgattntaattgctctgataatgaactggagagagacacactaagcttcctggatttctgttggaaatgaatgggattcttgccaactatggatcacagttatgaggtattctgcacagggaaaatcaaaagaaagcagatggaccttgacatgctatgccatcctatgccttcttccttcccaagaagcatgttacaataactttaagtgaaggttgcacaactttaagtgaaaagtctcccctttctgctaatttttaatgtaacttcccccttctcgatatatccagaaaataggtaataacaatccctgagggaaaagaaaaatgctgcc

SEQ ID NO: 50029 - DNA, 131 bp, Homo sapiens
  misc_feature 13, 17: n = A,T,C or G
aaacttagaaganaatnggaagatagaaacaagatagaaaatgaaaatattgtcaagagtttcagatagaaaatgaaaaacaagctgagacaagtattggagaagtatagaaaaaaaaaaaaaaaaaaaaa

SEQ ID NO: 50030 - DNA, 349 bp, Homo sapiens
  misc_feature 165, 336, 347: n = A,T,C or G
tcagagcaggcccatagtcttacaggccagagctcctctgttgtagccactcagctctgacatggttgtgtggaagccactgtggatgacacacaaagtgtgcactgttgtgttccaataaaactttatttatggatcttgaaatttgaatttatactgtacagntttcatgtgcacaaagtattttcttttgatttaaaaaaatcatttaaaaatgtaaaacccactggtagtttggaggccatccaaaaacaggggggggctagatttggcccatggttaagtttgccgacccctggcttagagatatgatttgagcaatgagaatatgtgcgngctccctcagnat

SEQ ID NO: 50031 - DNA, 308 bp, Homo sapiens
ctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattg

SEQ ID NO: 50032 - DNA, 145 bp, Homo sapiens
atttcttctctgacccaggaaaaaggcaattgctgcctgtttttttttcacccacagacaactgtggaccccaaaaaaaggccacactttcaaactttggctctcaaagtattgctgcccacaacttccaaaccagtcaaatggg

SEQ ID NO: 50033 - DNA, 308 bp, Homo sapiens
  misc_feature 199: n = A,T,C or G
attttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggtcattacatgatncatgagccagaaccacatattcttctctttagacgacctcttccaaaagatcaacaaaaatgaagtttatctggggatcggcaaatctttttcaaatttaatggatatg

SEQ ID NO: 50034 - DNA, 159 bp, Homo sapiens
ttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaaaaaaaaa

SEQ ID NO: 50035 - DNA, 256 bp, Homo sapiens
ataaagcaaatatcttcagagctaaagagagagacagatgtcaatacaataatagctagagacttcagcactctactttgagaagtggacagatcatccagctacaaattcaacaaaaaaacattggatctaatctgcactataaatcaaatggacctaacagatatgtacggaacatttcatccaatggctgcagaatacacattcttctcctcagcacatggataagtctcaagaacagaccttacattaggcc

SEQ ID NO: 50036 - DNA, 242 bp, Homo sapiens
gcatttgcatgactattagtgcttcaaagacaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaagtgactaaaactgtttgcatctttgtatgtatttattacatgatggaataaagcttattttcatt

SEQ ID NO: 50037 - DNA, 359 bp, Homo sapiens
  misc_feature 207: n = A,T,C or G
aacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggcaggcctacaatgaataggtatggtggntcacagaattttaaaatagagttaaagggaagtgatgacatttcggggggcattagggtagggagatgaatcaaaaaatacccctagtaatgctttatattttaatactgcaaaagctttacaaatggaaccatgcaattacctgccttagt

SEQ ID NO: 50038 - DNA, 351 bp, Homo sapiens
  misc_feature 37, 41, 45, 345: n = A,T,C or G
tgtgaactgttatcccattgaaaagaccgagccttgnatgnatgntatggatacataaaatgcacgcaagccattatctctccatgggaagctaagttataaaaataggtgcttggtgtacaaaactttttatatcaaaaggctttgcacatttctatatgagtgggttactggtaaattatgttattttttacaactaattttgtactctcagaatgtttgcatatgcttcttgcaatgcatattttttaatctcaaacgtttcaataaaaccatttttcagatataaagagaattacttcaaattgagtaattcagaaaaactcaagatttaagttaaaaagnggttgg

SEQ ID NO: 50039 - DNA, 270 bp, Homo sapiens
ctacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagcatcaattataattaactttcaaagggcaagtcagaagttgtttataaattacaaaataaaggcatattatgaactcttaaaaaaaaaaaaaa

SEQ ID NO: 50040 - DNA, 331 bp, Homo sapiens
tgtattttatggatccccaggagaactaaaaaggagatgactctctaccatagtttggtttaaaaaaaaattactctgcagttatttatttattatttaatactaaactccaaactgaagtggctctgaggtaaatcagatatgattttaatttaagtttctttattagcagatctataaatggaaggtgccaatgcactgcttctaaaatactgtcctaaacaacccagaagattttatttcagctcatgaatagctggtctaaatctgtggatggtagacatactatgactacctcttcacttattatggggaagttccttaataaaag

SEQ ID NO: 50041 - DNA, 198 bp, Homo sapiens
aacatttaaaaaatactctaatttttgctttcttgttttttgtcctattttattttattttgattttatttacgacttgattctttagtttttaaagtgatgtatttctagatcattgtacttaagggaatgtgacttattttgtctcattcagaatccagatatttcatctttaattacattaaaataccaacttgt

SEQ ID NO: 50042 - DNA, 345 bp, Homo sapiens
  misc_feature 33: n = A,T,C or G
ggagcaatcacaaaactgtaatttacttaccanatctcttcctttccgtagcctcgctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagattacattttg

SEQ ID NO: 50043 - DNA, 260 bp, Homo sapiens
aaataaacagcctagtgatacacctcaaggaactagaaaaccaatgacaaaccaaacccaaaattagtagaaggaaaagtatagtaaatatcagaacaaaaacaaaatagagactaaaaaacaatacaaaggatcaagagacaaaaagtgcgtgttttaaaaaaaagatacacaaaattgataaacctcctagctagactaaccatgaaaaaaggaagaagagtcaaataaaatcaaaaaaaaaaaaaaaaaaaaaaaaa

SEQ ID NO: 50044 - DNA, 298 bp, Homo sapiens
ccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgctgaaggtcacgatcatgttaccatatcaagctgaaaatgtcaccactatctggagatttcgacgtgttttcctctctgaatctgttatgaacacgttggttggctggattcagtaataaatatgtaaggcctttcttttgaaaaa

SEQ ID NO: 50045 - DNA, 274 bp, Homo sapiens
catcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcaagtataataaaggagtgatgtgcaacaa

SEQ ID NO: 50046 - DNA, 427 bp, Homo sapiens
ataacagcaaatacaataaaggtttcaacagtatgtatatggaaatagatagcaacttaccttttctctgcttcttgaacagaaacaatgtgccttgggtaaatacctacactcacttttcagtaatgtaataagaaatatataaaagaaagaattaaaaccaagacatataagagctacccaaagcaaatacaatcatcaaaacagcccaggaataaagtaaaattaaatccgtggggataagtgaatagcaaatgggaacaatggtggcaaatatcagaaaacacaccaaaatatacagtctccttcaaatagttggtctaggagctggcaattgcattatgcacagatgccataagataaaaagtggttgagttcagctaaatttacgagataacacaccagaaaatatattgctatagaccat

SEQ ID NO: 50047 - DNA, 277 bp, Homo sapiens
tggattgactggtcagttgctacaatcagaatatgctttcttggaccatgtttgaggctcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaag

SEQ ID NO: 50048 - DNA, 420 bp, Homo sapiens
caggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggcaaagacataacctcagacacatctggagattttcggaacgctttgctttctcttgctaagggtgaccgatctgaggactttggtgtgaatgaagacttgctgattcagatgccagggccttgtatgaagcaggagaaaggagaaaggggacagacgtaaacgtgtcaataccatccttacc

SEQ ID NO: 50049 - DNA, 202 bp, Homo sapiens
  misc_feature 45, 65, 68, 95, 119: n = A,T,C or G
cccaacagtttatttttattatttttttaaacaaaatttcacagntctgtaatgtaggcactttnatnttcattgtgatttatatataaggtaangtagggttatatttgggagtgacngcaagcatttttccatctgtgtgcaactaactgactctgttattgatcccttctcctgccctttcccaggtaatttaaattgg

SEQ ID NO: 50050 - DNA, 312 bp, Homo sapiens
  misc_feature 52: n = A,T,C or G
gaaataccttgagcagaatacaatgggaaaagagtctctacccctttctgtncgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtggctctatgtgaatatggacagttagcatttaccaacatgtatctgtctactttctcttgttt

SEQ ID NO: 50051 - DNA, 320 bp, Homo sapiens
  misc_feature 207: n = A,T,C or G
tttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgngaaggaaaacaatgcagtgaaagaaagtcttcatattaggacagatatcattgcatcacatttatttatctttctggggatttttatagcccttaataaaaaatattaaaata

SEQ ID NO: 50052 - DNA, 290 bp, Homo sapiens
agagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaaaaaaaaaaaaaa

SEQ ID NO: 50053 - DNA, 319 bp, Homo sapiens
  misc_feature 68, 84: n = A,T,C or G
caccacgaaaaggctggagcttcatgcatcctgggagactcacacatttgcatgaaggacttcctgtnaaaaatggaacaaganacattgcagtgcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattga

SEQ ID NO: 50054 - DNA, 209 bp, Homo sapiens
  misc_feature 123: n = A,T,C or G
aaaaaaattgaaaaacaaatcaactcttatccccaacagctgcctaattttaggagtctgaccctccacatctcactggtgtgggtgcatggggctgtggagtgggtgtcagtatggatgtgnctgaatgtgtgaggccttggaagggactctttctgcagatactgtaaatacaagtaccattttaataaagcatgtacaataaacct

SEQ ID NO: 50055 - DNA, 169 bp, Homo sapiens
aacaaaattagtttgtatcttggttattaaacagtatccgggactggtttgggcagaatattaaacttattttgttgccaattattgtttaccgagtataatgttgctatttagcaatgtgcttggttttaaagaaattctccttgggtaaaaaaaaaaaaaaaaaaaa

SEQ ID NO: 50056 - DNA, 154 bp, Homo sapiens
gacaagatgttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 50057 - DNA, 379 bp, Homo sapiens
gtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtaccgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactagctaaaactggacaaagaccgcaaaaagatcctcgaacggaaagccaaatctcgccaagtaggaaaggaaaagg

SEQ ID NO: 50058 - DNA, 206 bp, Homo sapiens
acctagacttggtaagaatatggagcaccgattgtgaatacatgaattgttcaaaccacctcaaaaatcattttcattatgagaactggaacatatgtatatcctgtgacccagtatttctattctttgtcttctagagaaactttttgtcatatataccataaggcctatacactattattcctagcaacatttattgaaatagc

SEQ ID NO: 50059 - DNA, 170 bp, Homo sapiens
gggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatg

SEQ ID NO: 50060 - DNA, 313 bp, Homo sapiens
agggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgcttggcataaattgacaatgtcaataaattgaaatatggttcactgtc

SEQ ID NO: 50061 - DNA, 312 bp, Homo sapiens
tgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgct

SEQ ID NO: 50062 - DNA, 312 bp, Homo sapiens
aaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggggcttggggacaaaactttttatatcaaaaggctttgcacatttctatatgagggggtttactggtaaattatgt

SEQ ID NO: 50063 - DNA, 311 bp, Homo sapiens
gcttattgcttaactgggctgaagattatctcatgtgacaccatagatctcttgttttggaattgccattactttctagaacaggcattctgtacagctgccaacatgccctgaatcctcttgcttcatattacagtgatactgctttgtcaggggagaattcagcctcacagggctggagtaagtctctgctgacctcatgccacagtacaacatggtcaaatctgggagaaacctgaggggtattcggaatattcctcctcctcctctctacaagcatggagccctcactctcctcggaaaccggatgt

SEQ ID NO: 50064 - DNA, 103 bp, Homo sapiens
ctcaggctctcacaggatccggagggaaatgtgttagagggtctggaaaattcagtgcttttgagttacttgtttttattaaaaatttcctcacaaaagagag

SEQ ID NO: 50065 - DNA, 216 bp, Homo sapiens
  misc_feature 29: n = A,T,C or G
ttcaagcagatttatgagcagatttctgncacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttca

SEQ ID NO: 50066 - DNA, 388 bp, Homo sapiens
  misc_feature 41: n = A,T,C or G
taacagtggggtaagcaaatgtgataactagatggtaatancctagtaatattataaaaagagcagtgaactgactttacgattctttggaaagctgaatgggtaaatgcagtaataaaagaagcaatcatctacctcagtgaaattataataaaatggttattgggcagcatggtggctcatgcctgtaatcccagcactttgggaggccgaggcaggtggatcatctgagatcaggagtttgagaccagcctggccaacatgttgaaaccccgtctttactaaaaatacaaaaaattagccaggcatggtggcaggtgcccataatcccagctactcaggaggctgaggtgagagaatcacttgacctgggaggcagaggttgccg

SEQ ID NO: 50067 - DNA, 237 bp, Homo sapiens
accaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagact

SEQ ID NO: 50068 - DNA, 188 bp, Homo sapiens
  misc_feature 30: n = A,T,C or G
caacgattaaagtcctacgtgatctgagancagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgt

SEQ ID NO: 50069 - DNA, 335 bp, Homo sapiens
  misc_feature 143, 168, 311: n = A,T,C or G
attttagatgttgaaaatactccctgcgcccggcattcaatattgtatggtcattaggatctgttgtggctgctttggacattttttgtcactagtagaattagaagatcatgtgatgttggagtaggagggtttatcttggngactttgggatgctggtttcattgnaggtataattatgcaaagcaaagaatccaggaaagaattgccagagaagaaattaaaaagaagatattatatgaaggacccacctcgatcctgaaagaaaacacaacgcagcagcagcaattgaacaatcttgagcatagaancaatgtaacgaagtaagatcaacc

SEQ ID NO: 50070 - DNA, 136 bp, Homo sapiens
aatgtgaaacagagaactgatatatgggctgtcatgtcaccctagggtactgtcgctctgtcatgtgtagcaatctttccaaatttttgttggtgggctgaacaaagataaaactaataaagtatgtgtggatacc

SEQ ID NO: 50071 - DNA, 226 bp, Homo sapiens
atgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcc

SEQ ID NO: 50072 - DNA, 219 bp, Homo sapiens
gggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgacaaaagaaccaagtttaaaagcattttgtggggacatcatttctataa

SEQ ID NO: 50073 - DNA, 254 bp, Homo sapiens
aatagttaaaatgctgacataacaccaaacttcattttttaaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgggttatggccaatctattctcaaagttaaaagtaaaattgtttcagagtcacagttcc

SEQ ID NO: 50074 - DNA, 165 bp, Homo sapiens
  misc_feature 101: n = A,T,C or G
gtgtgtgagcatgggtacccatttgataagagaaatgcatttgattgtgaagaagggagagttaaattctccattatgttcgtggggtaaagtttagagcnggaatttattataagaatgtaaaaccttaaattattaataaataactattttggctaaaaaaaa

SEQ ID NO: 50075 - DNA, 429 bp, Homo sapiens
  misc_feature 314: n = A,T,C or G
tttctggcctggaggctatccagcgtactccgaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgnaagcagcatcatggaggtttgaagatgccgcatttgggattggatgaattccaaattctgctgcttgctttttaatattgatatgcttatacacttacactttatgcacaaaatg

SEQ ID NO: 50076 - DNA, 151 bp, Homo sapiens
  misc_feature 27, 67, 77: n = A,T,C or G
aagaaaccagcccctgaaaagaagccngcaagagaagaaacctactacagaggagaagaagcctgcngcataaactnttaaatttgattattccataaaggtcaaatcattttggacagcttcttttgaataaagacctgattatacaggc

SEQ ID NO: 50077 - DNA, 132 bp, Homo sapiens
  misc_feature 60: n = A,T,C or G
aatcccagctactcaggaggctgaggcaggaggaatcgcttgaacctgggaggtggaggntgcagtgagccaagattgcgccattgcactccacacttcagcctggggcaacaaggagcaaaactccatctc

SEQ ID NO: 50078 - DNA, 306 bp, Homo sapiens
  misc_feature 44: n = A,T,C or G
tccttcttgccatcctggccgccttagcggtagtaactttgtgntatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgcgagggaccaaatgagactgaggg

SEQ ID NO: 50079 - DNA, 224 bp, Homo sapiens
aaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattgg

SEQ ID NO: 50080 - DNA, 299 bp, Homo sapiens
ccacgtttttgactggatcaaagcaagaagtggtgacaaccccgtgtacatctggggccactctctgggcactggcgtggcgacaaatctggtgcggcgctctgtgagcgagagacgcctccagatgcccttatattggaatctccattcactaatatccgcgaagaagctaagagccatccattttcagtggcaagtacagattttattaaaaattaacttttcattattaagataaattatagaaataactaattacaggatacattataataattattaaaaattattatttaaat

SEQ ID NO: 50081 - DNA, 222 bp, Homo sapiens
ctaggagaaaatcttcttgcctttgggtttgaaatatttcttaaacagagcacaaaaaaacactaaccatggtgaaaaatccaagctgaactggatttcactaaaattaagatatttttagtcaccaaaagacaccattaagaaagggaaaagtgggagaaagtatttgtagtgcatataaccaaaaagagaactcatatccaaaatataaaaacttttacc

SEQ ID NO: 50082 - DNA, 311 bp, Homo sapiens
  misc_feature 45, 272, 284: n = A,T,C or G
atattgtcctccacctccatcattttcaataaaagatagggcttntgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagnccttaagctggngattcctaatcaaggacaagccaccct

SEQ ID NO: 50083 - DNA, 310 bp, Homo sapiens
agctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatgggaaacaacttgccaaaaatttgcacagaattttgagacccattaaaaaagttaaatgag

SEQ ID NO: 50084 - DNA, 490 bp, Homo sapiens
gaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggcaagcaatactcagaaattcaggctgtgaggggttagattagaggaaagtaatttaggtgagctatccagagctttcaacctcagggtttataggaaaaaaaacaaaatacaaaaacccttaggacttctcatactctagccctgaccttgcagctcctctgagggcctcctaagacccttaaaataatattacaataggactttgagtgtcatttcacagtggaaatagcctcttggtagcattacttccaaatgctagttccagctaaaaacaagtactttttattag

SEQ ID NO: 50085 - DNA, 185 bp, Homo sapiens
  misc_feature 5: n = A,T,C or G
catcnactggaaaggttgagaatcaaagatactcctctaataagagcatacctaagcacctgtatctgagtttctaatgtcactgcccctctaaactgaaccatactcctggaatggctaatttcaggactggtgcaagatgatcctgaaacatcttatcagacaagatagtaaagaactgctgt

SEQ ID NO: 50086 - DNA, 464 bp, Homo sapiens
  misc_feature 10, 370, 372: n = A,T,C or G
ttggaaaatnaaattcataaaacatttataatagcgtcaaaaaaaagaaaatactcagaaataaatttgacaaaaattgtataagatctctacattaaaaattatgaaatacatgtaagagaaattaaagaaaacctaaatagagagatataccacattcatggattggaagattcaagattattaaaatactattctccccaaatggctctatagattcaacataatcccaatcaaaatcccagtaggctttggtagaaattgagatgttggtctaaaatgaaataaaatgcagaggcctagaatatataatttccctttaatttgacaaagaagaaaaacatgttggggaagctcacctaatttcagngnaatatttacatacgaatcaacaaatggatcagtggatagaatagagaatcctgaaatagatctacatatatatggccacagatttttaataa

SEQ ID NO: 50087 - DNA, 103 bp, Homo sapiens
tcacgcctgtaatcccagcactttgggagtctgaagcaggtgaatcacctgaggtcaggagtttaagaccagcctggccaacttggtgcaaccccatttctac

SEQ ID NO: 50088 - DNA, 367 bp, Homo sapiens
  misc_feature 15: n = A,T,C or G
gaatcaacagtactnagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaataggggcaccccttcaaaactgtacaaagaagacgactgttttccatttccatttaaacatttttagccacttcatttctatttattgaacaggcaaatttgtcttgtatttggtgagacagtacatttaaaaaacatccttatcggta

SEQ ID NO: 50089 - DNA, 344 bp, Homo sapiens
  misc_feature 31, 57, 84: n = A,T,C or G
aaggataactctgatacaataaatactgctntcctctaaaaagatcgtgtttaaatnaacttgtagaaaatctgctggaatggntgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcctaaagtgcaaatattaaaaaaaactgttctctgc

SEQ ID NO: 50090 - DNA, 238 bp, Homo sapiens
  misc_feature 13, 19: n = A,T,C or G
aagaaaaaaaatntctttntttctggaggctggcacctgattttgtatccccctgtagcagcattactgaaatacataggcttatatacaatgcttctttcctgtatattctcttgcctggctgcacccctttttcccgcccccagattgataagtaatgaaagtgcactgcagtgagggtcaaaggagagtcaacatatgtgattgttccataataaacttctggtgtgatactttc

SEQ ID NO: 50091 - DNA, 373 bp, Homo sapiens
  misc_feature 237, 273: n = A,T,C or G
atggtttgatacctcatttctctttagcactgaatggtattccattgcctggatgtaccatagtttatatcttatcatctactgaggatatcttggttgcttccaagttttggaaattatgaataaagctgctataaacatctgtttttagtctcttgtgtggatataagttacaactcatttgtgtaaatacaaaggagcatgattgctggattgtatggtaagagtatgttcagnttttttacaaactgccaaactgtcttttaaagtggnttttcattttacatatccaccagcaatgaataaaaattcttcttggggacatcctcaccagtagtgatgtcaatattttggatctgccattctaatagtt

SEQ ID NO: 50092 - DNA, 304 bp, Homo sapiens
  misc_feature 21, 59: n = A,T,C or G
ccctctttccaaagagctggnacagaagtacaacgtgcgatccatgcccatccgaaagnatgatgaagttcaggttgtacgtggcactataaaggtcagcaaattgcaaagtagtccaggtttacaggaagaaatatgttatctacattgaacgggtgcagcgggaaaaggctaatgcacaactgtccacgtaggcattcaccccagcaaggtggttatcactaggctaaaactggacaaagaccgcaaaaagatcctcgaacggaaagccaaatctcgccaagtaggaaaggaaaagggcaaa

SEQ ID NO: 50093 - DNA, 273 bp, Homo sapiens
  misc_feature 9, 24, 29, 46, 55: n = A,T,C or G
gccacaggngcagaaacatggaangccanacgctggggatgctggnacaagttgngggactgcatgctactgtctagagcttgtctcaatggatctagaacttcatcgccctctgatcgccgatcacctctgagacccaccttgctcataaacaaaatgctcatgttggcctctgccctggacctgtgacattctggactatttctgatttatttgtggccgagtgtaacaaccatataataaatcacctcttccgctgttttagctgaagaa

SEQ ID NO: 50094 - DNA, 191 bp, Homo sapiens
  misc_feature 31: n = A,T,C or G
gccaagatgtcgttcccaaagtataagccgncgagcctgcgcactctgcctgagaccctcgacccagccgaatacaacatatctccggaaacccggcggcgcaagccgagcggttgccataagagcccagctgaacgagagtacctgcttcagtacaacgatcccaaccgccgagggtcatggaaaatcct

SEQ ID NO: 50095 - DNA, 290 bp, Homo sapiens
  misc_feature 59: n = A,T,C or G
agagcaagactccatctcaaaaaaagataattaaatataaagacatagatattagaggntatgacctgagatgtcatttatggtattggaaggttttgtggtaaaaagtgactaatttatgaaatgattaaataccacttggtacaaaaagttgatttttttccccccagaagaaagtttttcaaaaccagtgtaagtttatagcgtgtttattttagtaaatttagaaattcttgaaatttatatgtaattttatttttactttggtataaagatagtagggagaagta

SEQ ID NO: 50096 - DNA, 282 bp, Homo sapiens
  misc_feature 53, 105, 206, 208, 209: n = A,T,C or G
gtggagccaagccggcagcatgtaaaggacttccattcggctggttaaaagangcactaaacctgatagaaaagaattccagaagattgccatggcaacagcaanaggatttgctataatgggattcattggcttctttgtgaaattgatccatattcctattaataacatcattgttggtggctgaatacattttggaagagagncnncatcttagagattggtgaacaagtgtgagggtgtgagaaactcacagaatacaaatttgcctgtatgttttgt

SEQ ID NO: 50097 - DNA, 389 bp, Homo sapiens
  misc_feature 25, 42: n = A,T,C or G
gaacaagttggaaaaaaacaatttntgtttcaattctaaganacacttgcagctctagtattcacttgagtcttcctgtttttcctgtaccgggcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggacttaagaatagatggtttttaatcctggaaattgtgattgtgacccatgagtggaggaactttcagttctaaagctgataaagtgtgtagcc

SEQ ID NO: 50098 - DNA, 287 bp, Homo sapiens
tagcaaacataatgctagtcctagattacttattgatttaaaaacaaaaaaaacacaaaaaaaatagtaaaatataaaaacaaattaatgttttatagaccctgggaaaaagaattttcagcaaagtacaaaaatttaaagcattcctttctttaattttgtaattctttactgtggaatagctcagaatgtcaggttctgttttaagtaacagaattgataactgagcaaggaaacgtaatttggattataaaattcttgctttaataaaaattccttaaacagtg

SEQ ID NO: 50099 - DNA, 452 bp, Homo sapiens
  misc_feature 295: n = A,T,C or G
tgtttttctctttgaaagatagagattaatacaactacttaaaaaatatagtcaatagggttactaagatattgcttagcgttaagtttttaacgtaattttaatagcttaagattttaagagaaaatatgaagacttagaagagtagcatgaggaaggaaaagataaaaaatgtatttaaaagaaaattgagagaaaggctacagagccccgaattaataccaatagaagggcaatgcttttagattaaaatgaagggtgacttaaacagcttaaagtttagtttaaaagttgnaggtgattaaaataatttgaaggcgatcttttaaaaagagattaaaccgaaggggattaaaagaccttgaaatccatgacgcagggagaattgcgtcatttaaagcctagttaacgcatttactaaacgcagacgaaaatggaaagattaattggga

SEQ ID NO: 50100 - DNA, 204 bp, Homo sapiens
  misc_feature 186: n = A,T,C or G
cttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatntgaccaaaattttaagta

SEQ ID NO: 50101 - DNA, 190 bp, Homo sapiens
ggactagcattgatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttg

SEQ ID NO: 50102 - DNA, 433 bp, Homo sapiens
gacctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtcccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggcaacagaatccttcttgataggttgcagcaaaacaaatgtaatgttgcagatccgcaggcagaagctctgcccttctg

SEQ ID NO: 50103 - DNA, 141 bp, Homo sapiens
ggacacccaatataaaacagtcaatatttgacaatgtggaattaccaaattaaaagagaatactatgaatgtattcatattttttctatattgaataaacaatgtaacatagataacaatataaataaaagtggtatgacc

SEQ ID NO: 50104 - DNA, 130 bp, Homo sapiens
  misc_feature 29, 46: n = A,T,C or G
ccattttctaagaaagattggtatgatgngaaagcacctgctatgntcaatataagaaatattggaaagacgctcgtcatcaggacccaaggaaccaaaattgcatctgatggtctcaagggtcgtgtgt

SEQ ID NO: 50105 - DNA, 174 bp, Homo sapiens
  misc_feature 56, 57: n = A,T,C or G
gtttttttagttctgtatgtattttagcaatctcatctcacctaactgagatgtgnntcaattatattccttttatggaaaaggactctgaaaaaccctaaagtattctagggagaaactgtcttccatttcagttttgaatcagtattgttacactcaaaccaccctcttttt

SEQ ID NO: 50106 - DNA, 436 bp, Homo sapiens
  misc_feature 7, 54, 63: n = A,T,C or G
ctttggntagaagaataatgagtgatctttacttttttactttttattcatctntgtgttttnatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacataagtaattaattaagaaaatcgagcacccttaattacctagaatgcagggttgtagttttttggttgacttttgttttgctggggcattctgccatgtttagtgtcatttaataaataatagtaacaataaagggtaacattta

SEQ ID NO: 50107 - DNA, 278 bp, Homo sapiens
gtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 50108 - DNA, 343 bp, Homo sapiens
  misc_feature 42, 43, 50, 67, 120, 121, 122, 127, 134, 135: n = A,T,C or G
gaatgtttttcaatgtccttatttcactcacagttttgaaannttatttntgcatagaattctaggntaatttttttctctagtactttaaaaatgttgccatttatgaagcattgccannnaaagnatcatcnntcatgtgcttgcgaaaatggcataaagccggttcttgtgctggtatgtaattttcagaatgtgtatttaaatttaaaatattaaattttcctaaaaaactaaaaatattaatcatgaatgtcctagattcatcttaaattccaccaacagtgcacttaaaatgtgcccaacctgagggcaaacctacctgctgacatgtaatttgtgt

SEQ ID NO: 50109 - DNA, 424 bp, Homo sapiens
gaagaacggaaggatgcctctttgcctctgctttgcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaacttgcagaaaattagacagtgttaattttcgaaaac

SEQ ID NO: 50110 - DNA, 193 bp, Homo sapiens
  misc_feature 68, 119: n = A,T,C or G
ttattttttttaaagaaaagatgaaaggcaggcctatttcatcacaagaacacacacatatacacgantagacatcaaactcaatgctttatttgtaaatttagtgtttttttatttcnactgcaaatgatgtgcaaaaccttttactggttgcatggaaatcagccaagtttataatccttaaatcttaatg

SEQ ID NO: 50111 - DNA, 554 bp, Homo sapiens
  misc_feature 9, 67, 444: n = A,T,C or G
gagagaganaaggagcggtatcttacaggaacatgaacaaattaaaaagaaaactgtccgagagcgnttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcanagctgcacgcagctgtttatgaggaaaaacttaaacagtttgaagagcgattagcagaagaaagcataatcgattgggaagaacggaaaaggcagcgtaaagaagaacgc

SEQ ID NO: 50112 - DNA, 432 bp, Homo sapiens
aaggctgaaggaaatagcaaattcacctacacagttctggaggatggttgcacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttggtttatttttttaccaattccaatttca

SEQ ID NO: 50113 - DNA, 403 bp, Homo sapiens
  misc_feature 349: n = A,T,C or G
tttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaataaataaaagtgataagaatgtgacatgtaatagggagagatattagtccgatggtaattaaaagcagagaaagtttaaataactaaatggtgaagaattggttgntcaacaataggagttattttgaagaataaagcaagtgattaaacatgtgaaaag

SEQ ID NO: 50114 - DNA, 266 bp, Homo sapiens
tacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatat

SEQ ID NO: 50115 - DNA, 421 bp, Homo sapiens
  misc_feature 10, 280, 287, 415: n = A,T,C or G
catgtaattnaatgataaactatagccaaacacccattaaaaaacaaggaagcattatatttcctgatttcaaaacgtattaaaagctaaataagacaaacaatatggtactaacacatagataaacaggtgaaagacaatagagagcccagaaataaacccttccacgtataatcaaatgattttccacaaagttgccatgagcacacaatagagagaagctaatctcttcaaaacataatgttgaaaactagatatcaacaccgataaaatacaattntagaatntccatgaaactgcaataaactttgaatagtcaaagcaatcttaaaaataaaaacaaagcacagggcatcatactttttaacttcaaactatatttgaagactatagtaatataaacaagatgaaatgngcagaa

SEQ ID NO: 50116 - DNA, 130 bp, Homo sapiens
  misc_feature 54, 55: n = A,T,C or G
tcatcattggccctcattccaagcactttacgctgactgtaatgggatctattnntgcactggaatatctgagaattgcaaaactagacaaaagtttcacaacagatttctaagttaaatcattttcatt

SEQ ID NO: 50117 - DNA, 243 bp, Homo sapiens
  misc_feature 75: n = A,T,C or G
agttgagtttgctctaaagtgggaataaaaatatctccagttggtacttaagagaactaaatgaagtatgaaagngcctttggtaagctagaaagcattatacagatgtcatccacttttaaaagggggttaagccattttcttaaatgagaatttttccagaaagggatatttttgccaaatttcagtttcttatacaaggcttcgctagtgttacatgtgcatttcttcccttaaatcttt

SEQ ID NO: 50118 - DNA, 457 bp, Homo sapiens
ctctatgtgaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttaggataaacttggcttgctagagacccatgtcatcttaacctaaagggaaatcttattgcgttatcataaaattgatgatatcttagggtcagaattacccttttttttattttgaatgggaagtctcactaaaacaatcctgagatttcttaatttcatggtctttaaatattataaacacagagtcaacatagaatgaaattgtatttgtaaaatacacacattggaggacaagagcagatgctacttttcgaagtaatgctgctccttcctaaaggctgttttcaatcctg

SEQ ID NO: 50119 - DNA, 310 bp, Homo sapiens
  misc_feature 76: n = A,T,C or G
aacaagttaccctagggataacagcgcaatcctattctagagtccatatcaacaatagggtttacgacctcgatgntggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtt

SEQ ID NO: 50120 - DNA, 168 bp, Homo sapiens
gtggcatggttccgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactacctt

SEQ ID NO: 50121 - DNA, 111 bp, Homo sapiens
gggctacggaaacaggccgagaagaacgtggagaagaaaattgacaaatacacagaggtcctcaagacccacggactcctggtctgagcccaataaagactgttaattccg

SEQ ID NO: 50122 - DNA, 416 bp, Homo sapiens
  misc_feature 87, 392: n = A,T,C or G
gccgcctaaggacgacaagaagaagaaggacgctggaaagtcgccaagaaagacaaagacccagtgaacaaatccgggggcaaggcnaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggcagggcagccttcaggagctccttagtaaaggacttatcaaactggtttcaaagcacaggagctcaagtaatttacaccagaaataccaagggtggagatgctccagctgctggtgaagatgcatgaataggtccaaccagctgnacatttggaaaaataaaactttat

SEQ ID NO: 50123 - DNA, 396 bp, Homo sapiens
acacagctcagccgaaacgccaatcaacagtccttctcccggactggagttggcacagaggaggaccacataaaacagtatctgagacgcagaacatttcatcgagtacgctgccaactatgagaaacagtcagctttagtaagagggagcaattccggtggctggctgttctataaacattaacaaggtccttaattttacagcatttaaaaacttttctggttttggttcactgggatttttaaagcttagatgtgaaaatgactactgaaaattatctacatttacagtcactcacacacgtttatttaatgtcagtatagagaggacagccccacagtacttcagaatatcaagtatgtagtaagtcttgttagctgtgacagtgacaaggc

SEQ ID NO: 50124 - DNA, 202 bp, Homo sapiens
  misc_feature 30: n = A,T,C or G
agccagaggcccttgtcctctcccctttgnagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataaggg

SEQ ID NO: 50125 - DNA, 211 bp, Homo sapiens
  misc_feature 66, 74, 100, 120: n = A,T,C or G
cattcttggaaaaaatagtaacttttaagttagcttcaaggaagatttttggccatgattagttgncaaaagtnagttctcttgggtttatattactaantttgtttttaagatccttgntagtgctttaataaagtcatgttatatcaaacgctctaaaacattgtagcatgttaaatgtcagaatatagtagatttgttgtatatggct

SEQ ID NO: 50126 - DNA, 223 bp, Homo sapiens
  misc_feature 11, 34, 69: n = A,T,C or G
aaaagggacangcatcaagcacgcagcaatgcangctcaaaacgcttagcctagccacacccccacggnaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 50127 - DNA, 354 bp, Homo sapiens
agcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttgctgaaacaaagaatttgtcctgtatggaaaacgggagactttgtacagtggcctctctaaaagtacaaaacattcataagagaacctgcatacattttgatattaagaaataattccgg

SEQ ID NO: 50128 - DNA, 475 bp, Homo sapiens
  misc_feature 95, 418: n = A,T,C or G
agtacagaacctgctaaggccatcaaacctattgatcggaagtcagtccatcagatttgctctgggccggtggtaccgagtctaagcactgcggngaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgcctacctcaggttgaaacttttggctttcggggggaagctctgagctcactttgtgcactggaggtgataaaatatttttatccattcactttgaccccttagaaaaacctctctgaaaattaattgggaatcattattatttacagttnctgtctcaatatctcagcttccagcttctgaattctgtttgtctcactgccaatcta

SEQ ID NO: 50129 - DNA, 229 bp, Homo sapiens
  misc_feature 30, 31: n = A,T,C or G
tttaatttattggctctttagctatactgnnttaataatttttttaagttggatgttctagtgattacaatatacattcttaatttttcagtctacctagagttgatgtgccacttcacatatttaaatattgtaagtcctgtcataagttacaatttctgctttaaataatgatatgtattttaaagaaattaagaggaaaaaataaaatcttttgtatttattcaca

SEQ ID NO: 50130 - DNA, 354 bp, Homo sapiens
aaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttaagggaaaaaaatt

SEQ ID NO: 50131 - DNA, 294 bp, Homo sapiens
tcgtaaggtgctccgggataacatccagggcattacaaaaccggctattcgccgtttggctcggcgcgggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggctcctgagaacttcaaaaaac

SEQ ID NO: 50132 - DNA, 352 bp, Homo sapiens
ttcttgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagctatgaaaccaaaattttagtctatacaacaaagcttaataagacatgcaaaaattta

SEQ ID NO: 50133 - DNA, 392 bp, Homo sapiens
  misc_feature 366: n = A,T,C or G
caggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaactngtgcaaaaagatagaatcaatcataa

SEQ ID NO: 50134 - DNA, 412 bp, Homo sapiens
tcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagcatcgaaaaaccccaggcctgaagaaataaagtaaaattaatctggtaatttgcacggattagttgtacaactagttagaagttcagaataaacatgcatttc

SEQ ID NO: 50135 - DNA, 179 bp, Homo sapiens
ttttgattatcaaaaagggttctgcacattgtttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacact

SEQ ID NO: 50136 - DNA, 327 bp, Homo sapiens
  misc_feature 17, 75: n = A,T,C or G
gaccaagaatttggtgnggacgttggccctgtttgctttttataaaccaaactctatctgaaatcccaacaaaanaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgatacc

SEQ ID NO: 50137 - DNA, 191 bp, Homo sapiens
  misc_feature 31, 45, 51: n = A,T,C or G
ctatcactgtattttaatatttgttattctntcatgaatagaaanttatgnagacgcaaacaaaatacttttacccacttaaaaagagaatataacattttatgtcactataatcttttgttttttaagttagtgtatattttgttgtgattatctttttgtggtgtgaataaatcttttatcttgaatgt

SEQ ID NO: 50138 - DNA, 150 bp, Homo sapiens
gttactgtgagattttaaatatccacaggactcactttttccaaatgatcctaggaattgcctagaaatatctttctcttacctgttatttatcaatttttcccagtatcctatacggaaaaaattgtattgaaaacacttagtatgcag

SEQ ID NO: 50139 - DNA, 398 bp, Homo sapiens
gcttgcctggctggacgctactccggacgcaaagctgtcatcgtgaagaacattgatgatggcacctcagatcgcccctacagccatgctctggtggctggaattgaccgctacccccgcaaagtgacagctgccatggcaagaagaagatcgcaagagatcaaagataaaatcttttgtgaaagtgtataactacaatcacctaatgcccacaaggtactctgtggatatccccttggacaaaactgtcgcaataaggatgtcttcagagatcctgctcttaaacgcaaggccgacgggaggcaaggtcaagtttgaagagagatacaagacaggcaagaacaagtggtcttccagaaactgcggtttagatgctttgttttgatcgttaaaaatta

SEQ ID NO: 50140 - DNA, 366 bp, Homo sapiens
  misc_feature 15: n = A,T,C or G
ggaaaaacgttcttntttaaggattctcagtactggcgttttaccaatgatataaaagatgcagggtaccccaaaccaattttcaaaggatttggaggactaactggacaaatagtggcagcgctttcaacagctaaatataagaactggtctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttat

SEQ ID NO: 50141 - DNA, 367 bp, Homo sapiens
atcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtggcttttaaaaactccatcctttataaatagtcaaggttgggccacacaaagatatttttatcatggaaaaatttcaactcctcaagccgtaatgttgaacagaat

SEQ ID NO: 50142 - DNA, 334 bp, Homo sapiens
  misc_feature 50, 51, 52, 56, 104, 133, 303: n = A,T,C or G
aagaggaacagctctttggacactaggaaaaaaccttgtagagtagagannnaaanttaacacccatagtaggcctaaaagcagccaccaattaagaaagcgtncaagctcaacacccactacctaaaaaatnccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagncattattaccctcactgtcaacccaacacaa

SEQ ID NO: 50143 - DNA, 401 bp, Homo sapiens
  misc_feature 146: n = A,T,C or G
ttgataaccatgaatcttacaatttttctcatagaatagatcatttgtcttttggagagcttgttccagcaattattaatcctttagatggaactgaaaaaattgctatagatcacaaccagatgttccaatattttattacagtngtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgcagttactgaggagcacatgccattctgcagttttttgtaagactctgtggattgttggaggaatcttttcaacaacaggcatgttacatggaattggaaaattatag

SEQ ID NO: 50144 - DNA, 394 bp, Homo sapiens
ggatgtgcatttcttgtgatgttatgaatacatttctactttattttgaaacatttgccaaactaaatactgtaacactgtataacatttaaaaatgttaaagaactgcttagtattagaagcagatcatttcctaaaattctaagagcagcagcatatgttgttgcttgtataaagcctagcggataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcactaaaaaaaaaaa

SEQ ID NO: 50145 - DNA, 125 bp, Homo sapiens
  misc_feature 10, 47, 54, 64, 69: n = A,T,C or G
tctctttttntgctggtccaccaaatacaattcaaatgctttttggnttatttntttaccaatnccaanttcaaaatgtctcaatggtgctataataaataaacttcaacactctttatgataac

SEQ ID NO: 50146 - DNA, 204 bp, Homo sapiens
  misc_feature 73, 81: n = A,T,C or G
acctgcctgtagccccagtgacagctaggatgtgcattctccagccatcaagagactgagtcaagttgttccntaagtcanaacagcagactcagctctgacattctgattcgaatgacactgttcaggaatcggaatcctgtcgattagactggacagcttgtggcaagtgaatttgcctgtaacaagccagattttttaaaa

SEQ ID NO: 50147 - DNA, 425 bp, Homo sapiens
  misc_feature 25, 389: n = A,T,C or G
gaacgactttttctaacaccacggncccaacagcctgccccctgctccctgctgcagaccctgcaataatagttggttagagtgttttgtgcatgaaatgacttggattgttaatttagtttgtggaatgcatccagctctggctggccacagttttgaataaggcaagttggctttcaggactttattcccttcgtacacctttctttccaatgagacacccaggaaactcacgaccaatcttgggcttgttagtaacgtcacactacaactagggcagggtttctccctggctaccgtagtctcaaatggaggcctttctcgcattgaataagcagctcagctctttgaacgctgaagtttcactgcctccaatctagcagcaccgnagtctccggtttaaaactttcttctgagtaaggaga

SEQ ID NO: 50148 - DNA, 415 bp, Homo sapiens
  misc_feature 121, 136, 146, 170, 188, 231, 263: n = A,T,C or G
atagagattaatacaactacttaaaaaatatagtcaatagggtactaagatattgcttagcgttaagtttttaaccgtaattttaatagcttaagattttaagagataatatgaagcttanaagagtccatgatgnaaggacaagntaaaaggtttctaaaacatgacgnaggttgagatgaagctcntcatggagtaaaaaatgtatttaaaagaaaattgagagaaagnactacagagccccgaattaataccaatagaangggcaatgcttttagattaaaatgaaggtgacttaaacagcttaaagtttagtttaaaagttgtagggtgattaaaataatttgaaggcgatcttttaaaaagagattaaaccgaggtgattaaaagaccttgaaatccatgacgcagggag

SEQ ID NO: 50149 - DNA, 188 bp, Homo sapiens
aaggagcttttgaagtaatgtaaatgcactttcaattcatgtgtatagcgccatctgatatcttgggtaagacttgctttttcttttctttttcctctcccctgcccccttaattaaatggcacggaaatgtttcttaatatgcacgtgagtctccagagtacaggaaatgtgctttcctctaaatgg

SEQ ID NO: 50150 - DNA, 280 bp, Homo sapiens
aacacctgccaccccactcttaatcagtggtggaagaacggctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 50151 - DNA, 229 bp, Homo sapiens
  misc_feature 121, 154: n = A,T,C or G
tagctccggagaatcaagatcttaagtgaagcctttctgttcagatgtgatctataaaaaatcataatttggggaaagtttaagcaaatctggctttgaagcctgatgtcataagtgactntgcgatcaaactgtcaggcttgggttcttgtanagaatgctcggtatagaaaaaccatgccatcattaatgctaacaacacgtagggcttcatgtcatgtcaaagata

SEQ ID NO: 50152 - DNA, 489 bp, Homo sapiens
  misc_feature 12, 458: n = A,T,C or G
gcagagaagctncatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataataggagataagtccattttttaaaaatgttttccccaaaccataaaaccctatacaaggtggtctagtaacaatacatgagaaagatgnctatgagctgaaaataaaatgacgcacaagt

SEQ ID NO: 50153 - DNA, 321 bp, Homo sapiens
  misc_feature 16: n = A,T,C or G
taagaacagtgcaatnaaattagaactcaggattaagaaacttactcaaaactgcacaactgcatggaaactgaacaacctgctcctgaatgactactgggtaaataacaaaattaaggcagaaataaataaattctttgaaaccaatgagaacaaagacacaatgtaccagaatctctgggacagaactaaagcagtgtttagagggaaatttatagcactaaatgcccgcaggagaaagccggaaaaatctaaaatcgacaccctaacatcacgattaaaagaactagagaagaagagcaaacaaattcaaaagcaagc

SEQ ID NO: 50154 - DNA, 405 bp, Homo sapiens
agacttaaagtgtaataaaaaataataataaatcaagctcagtaaaatctcaagggaatttcaaagtttccttatgtatagcacattttgggaataaaaggggaaaatctattagatttttaaataaattcattaacaaaaaaatagtaacatggatggatcttaaaaacataatgctaatttaaaacatagcaaacaataagaaacataatatcacataaaaaaacacacaaaacaatgacaatatatgttttggaaaaacacattgaaataaaaatctagacactacatcactgacacataagaagaaaaggaagcactgatgagagggaagacatttcatttaaaaagtgtgaatccaagaatggatgagataagagggagctaaaagaaaaagagtggtca

SEQ ID NO: 50155 - DNA, 422 bp, Homo sapiens
  misc_feature 49, 68: n = A,T,C or G
aagacacaggttaggagacgtcgctttgaacgtgctataggaccttctnaaacacacaccatcagaantcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagcaactaatgaagaaatgaataataaattttgacactgaaaaacattttattaataaagaatattgacatgag

SEQ ID NO: 50156 - DNA, 319 bp, Homo sapiens
  misc_feature 52: n = A,T,C or G
aaaatgcagaagtggctctgtccccccagagttaaggatttgctacactggncctctggaagcatttaagtagaagaaaaggcttatagtcagaatcactttagtaatcgtcttctggtccttggacttttctgttctgtaatgcttgtaacaatgaatatggtgttgcaatctagtctgatatcattgttgacctgtacttactttgtggatggttctacctggggttgcactggcacaaacagagccagaacactggactttcaaaagaccattttgacttctacagtgtccacacacatgaatttaaatgcacttg

SEQ ID NO: 50157 - DNA, 421 bp, Homo sapiens
  misc_feature 22, 34, 38: n = A,T,C or G
gacaggagaactataagcctgntggatctcctanaagntgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaagccattttagcaaattatggttatatgttttaatgtaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcacaaaaagatattgattggca

SEQ ID NO: 50158 - DNA, 372 bp, Homo sapiens
  misc_feature 126, 134, 153, 192, 193, 316: n = A,T,C or G
gacaatcattgaatacaaaacaaataagccatcacgcctgcccttccttgatattgcacctttggacatcggtggtgctgaccaggaattctttgtggacattggcccagtctggttcaaataaangaactcantctaaattaaaaaaagaangaaatttgaaaaaactttctctttgccatttcttcttcnncttttttaactgaaagctgaatccttccatttcttctgcacatctacttgcttaaattgtgggcaaaagagaaaaagaaggattgatcagagcattgtgcaatacagtttcattaactccttnccccgctccccaaaatttgaattttttttcaacactcttacacctgttatggaaaa

SEQ ID NO: 50159 - DNA, 335 bp, Homo sapiens
  misc_feature 43, 45, 83, 147, 322: n = A,T,C or G
aaaggaaattattttcaaaactgtgttcactgtttgggtgtgngnatggctctgcatgtgtgtgtttttgtctctgtataggnagaggtattcacatcttactccgactgtaaggttgtcttacttcatctctgcccccaccacagntgccattttgtaatgtccttccaacatggagaagacacgagctctctccagttggcatcatttgtcttttttgttgattgcctcattctccagtgaactccatctggccaattgattcagaatcaggcaagatccctgccctttgcacatccactgaaaggccaaacagcaagtncgagtgagtttta

SEQ ID NO: 50160 - DNA, 283 bp, Homo sapiens
  misc_feature 86, 87: n = A,T,C or G
aattgttaaatactactctgcttgacttactcagttttggtgggaagatctgggtcaattggaatagtacacctttctcagggttnncagtttaataaggttgtcatattattcccaacatgggaatatagtggcttctaaagtttgcaaatgaattatgtaaaaggattttctgtgtattaggaaggcaacctgttctgttcatggtatattaacacttcattgcatgtgctacccttaaaattgctatttgtagtgaagaaaaaagcatagtggaatttag

SEQ ID NO: 50161 - DNA, 414 bp, Homo sapiens
gacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggtcttttttcagttattttgaaggccagcatcctgattaaatgtctgacacattaatgaatgaccagcagcagctttcagctcttaaaaagacacttatattttgattttacatgctggtacctgttccattgttgcaaatgcccactctccatcagatgtgtcctccatttcttatccacaaagtactcctcact

SEQ ID NO: 50162 - DNA, 194 bp, Homo sapiens
taagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccccg

SEQ ID NO: 50163 - DNA, 240 bp, Homo sapiens
  misc_feature 21, 39, 70, 208: n = A,T,C or G
agtatttatgaggaaattctncttcctggcaggtagctnaaagagtggggtatatagagccacaacacangtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgnaactataatagagactctttaaggagaatctt

SEQ ID NO: 50164 - DNA, 216 bp, Homo sapiens
  misc_feature 98, 130, 175: n = A,T,C or G
gagctcatgagttcaagaccaacctgggcaacatggcaaaaccttgtctctacaaaaaatacaaaaattagccaggcatggtggtgcacacctgtagncccagctacttgggaggcttaggtgggagganggcttgagcacgggaggcagaggttgcactaagccaagatcgtgncactgcactccagcccaggcaatagagccagaccctgtctc

SEQ ID NO: 50165 - DNA, 360 bp, Homo sapiens
gcagagctcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccaggcacctatgaggattatgtcgaaggacttcgggtgtttgacaaggaaggaaatggcaccgcatgggtgctgaaatccggcatgttcttgtcacactgggtgagaagatgacagaggaagaagtagagatgctggtgca

SEQ ID NO: 50166 - DNA, 412 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttaaaag

SEQ ID NO: 50167 - DNA, 392 bp, Homo sapiens
  misc_feature 389: n = A,T,C or G
gactccctggccaacagaatccttcttgatagtttgcaggcaaaacaaatgtaatgttgcagatccgcaggcagaagctctgcccttctgtatcctatgtatgcagtgtgctttttctcgccagcttgggccattcttgcttagacagtcagcatttgtctcctcctttaactgagtcatcatcttagtccaactaatgcagtcgatacaatgcgtagatagaagaagccccacgggagccaggatgggactggcgtgtttgtgcttttctccaagtcagcacccaaaggtcaatgcacagagaccccgggtgggtgagcgctgcttctcaaacggccgaagttgcctcttttaggaatctctttggaattgggagcacgatgactctnagt

SEQ ID NO: 50168 - DNA, 312 bp, Homo sapiens
ccatgtgtgtcctggagacggtggtaccctgaaggcagaggccagctgccgcaagacagcaatgacagtccacctgccgacctgattcctgcatcatggaataaccacatggctaccttctatcctctgttcccaaatggtggtgcacttatcctgaagtcgtcaatgatttccctttgaaactactttattttactaatttaaactattttgtactgatgtagccctgaggtagttcatgaaaatgctgtcactcattccatggaataaatgttggaaagctgatcttttctgatataaaatgttgaatga

SEQ ID NO: 50169 - DNA, 159 bp, Homo sapiens
  misc_feature 26: n = A,T,C or G
gagtatccatattactatgctaatcnctaggctacaaaaacaaatgcccaggaaaatttttattacatgagacacattaaattgaactgtagattatttttatagtttcaacttcattctaaatgtctttttagctcaatcagtaaaaccaagtacaag

SEQ ID NO: 50170 - DNA, 184 bp, Homo sapiens
  misc_feature 135: n = A,T,C or G
aaactacatacatataaaatatcagcagacacccatcagttttctgtgacagaaagggacgtatcattaaccatgctgcaggcagccatggagtctctgggatatttatgaaatatgatctcagtctcttatggngcagttactgaggagcacatgccattctgcagttttttgtaagactctg

SEQ ID NO: 50171 - DNA, 453 bp, Homo sapiens
  misc_feature 414, 444: n = A,T,C or G
gggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgcattgaagactccttcccctcggcattggcagtgggggagaaaaggcttcaaaggaacttggtggcatcagcacccccctcccccaatgaggacaccttttatatataaatatgtataaacatagaatacagttgtttccaaaagaactcaccctcactgggtgttaaagaattcttcccaaagtcattactgataataacattttttccttttctagttttaaaaccagaattggccttggatttttattttggcaattgnaactccatctaatcaagaaagaataaaagnttattgcac

SEQ ID NO: 50172 - DNA, 415 bp, Homo sapiens
  misc_feature 7, 21, 33, 36, 44, 334: n = A,T,C or G
ctaaggnaaactgcagatggncctaatctctgnganacagcccngaagctgcccttgtgtttcccatgtagtggaaacagggtgctcaggagtcaggagacctgggttttgtcacctgcttctgtccatacatctttgactacattgtcagggcctaacagtccttccctgcctacctcactgaattgttggaagggtagatggaggctgcgaaagtgttttgcaaaggataaaacattagcacgaagctgctgcttattgttatcttattttctctattctttcctgcagggaattacatttcaaaaaaacatgggaaaactttatttgatgngttggtctaaatgagtgtgaacaagttcacaaaagccagtttagggagaccagttaaactcagagtcacttaaaaatcgca

SEQ ID NO: 50173 - DNA, 336 bp, Homo sapiens
gcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgccta

SEQ ID NO: 50174 - DNA, 384 bp, Homo sapiens
  misc_feature 10, 366: n = A,T,C or G
acctgtaatnccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtacgcaaattatctactattgcaggtgccttattggtagagggctctgaagagccaaaactgtatatgcaacacttgtaagataaaagggactttaataatcaagattttcttgaagatttgttagaaataatgcttattctgggaacctttcccttttgnattaataactctactaac

SEQ ID NO: 50175 - DNA, 347 bp, Homo sapiens
  misc_feature 347: n = A,T,C or G
ctggctatttatttatgtatttatttatcttgttgacgggaagattcaaattgacatacacaatcaccctcataaggatttcaggtaaaaaacagacaaagatttagatatcagatgtgttttacaattaccgcaccagtctttttctacagaatctagtagtatatttccaatagatctaggtgaaaatttctatctcatgagccttctgtcaagtatttttaaaattggatactctattagtggccaaattgaatctcttacagacatctcactcaaactgcagtcatactttccaatagggccccgtaaaaatccttcttctggagcaacctaatatatttatn

SEQ ID NO: 50176 - DNA, 228 bp, Homo sapiens
atgaatataccagctatcttgttaacactttcctggtgtaacttttcatccttctttcaacctctatggctgtttaagttctagatacatattttcaaacagtatatagcagattttttattcaatctggcaatctttgacttttaactaaagagaatagtccattttcatttattgtaattagcaattgctgtctattctgattcattcccactaatatattttata

SEQ ID NO: 50177 - DNA, 286 bp, Homo sapiens
agcacaacttggctttggcatgatttatgattccctggattatgcaaagaaaaatgaacccaaacatagacttgcaagacatggcctgtatgagaagaaaaagacctcaagaaagcaaccgaaaggaacgcaagaacagaatgaagaaagtcagggggactgcaaaggccaatgttggtgctggcaaaaagtgagctggagattggatcactgccgaaggagtaaaggtgctgcaatgatgttagctgtggccactgtggatttttcgcaagaacattaataaact

SEQ ID NO: 50178 - DNA, 210 bp, Homo sapiens
  misc_feature 27, 41, 55: n = A,T,C or G
tttaaattagccaatgtggaattagtntagcctgtgcagtntaacccaagccaanaggggaaccatacagcagcagggaccacgtgcctcagggataagagccccttcccctcccttgtccaagtgtgcgcttaccattgctccatctgtaagggtgcacccttctatagaagtacgttgtcttgctgagaattaaaaagaaaattttac

SEQ ID NO: 50179 - DNA, 215 bp, Homo sapiens
atagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaat

SEQ ID NO: 50180 - DNA, 248 bp, Homo sapiens
  misc_feature 41: n = A,T,C or G
accaagaagcgggtgctcaccctccgcaagtccttgctggngcagacgaagcggcgggctctggagaagattgaccttaagttcattgacaccacctccaagtttggccatggcgcttccagaccatggaggagaagaaagcattcatgggaccactgaagaaagaccgaattgcaaaggaagaaggagcttaatgccaggaacagattttgcagttggtggggctcaataaaagttattttccactg

SEQ ID NO: 50181 - DNA, 443 bp, Homo sapiens
cctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgctttcccatctgtctatctatctggctggcagggaaggaaagaacttgcatgttggtgaaggaagaagtggggtggaagaagtggggtggacgacagtgaaatctagaggaaaac

SEQ ID NO: 50182 - DNA, 499 bp, Homo sapiens
ccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagcgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggcatgggggaagaatgtaggggttgtggcactgcacagacacaggaaaatccatttccccactcttttatttttgctattctgatcatttgcccccttttaaaaataaacttcccatgtcttcc

SEQ ID NO: 50183 - DNA, 429 bp, Homo sapiens
  misc_feature 19, 33, 50, 53, 62, 63, 385: n = A,T,C or G
gcctgttctgcttcgaagnattcaataccgctnagtattttaaatgaagngantctaagatnnggctagggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggnataattatggtgggtgattattttttatactgtatgggccaaag

SEQ ID NO: 50184 - DNA, 365 bp, Homo sapiens
  misc_feature 16, 30: n = A,T,C or G
aatcttgtgtagtctncaactggttagtgngaaatagttttgccacctctgacgcaccactgccaatgctgtacgtacttgcatttgccccttgagccaggtggatgtttaccgtgtgttatataacttcctggctccttcactgaacatgcctagtccaacatttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacaac

SEQ ID NO: 50185 - DNA, 113 bp, Homo sapiens
  misc_feature 99, 102: n = A,T,C or G
aagtctgcccagaaagctcagaaggctaaatgaatattatccctaatacctgccaccccactcttaatcagtggtggaagaacggtctcagaactgttnggntcaattggcca

SEQ ID NO: 50186 - DNA, 222 bp, Homo sapiens
  misc_feature 179: n = A,T,C or G
acgtgttctgactgaatatttaatatctgctttattgggttattatgtgataattttttcctttcttcaaaataaggcaatgatggccaaaccacagtgcacaaacaagatcattagcagctttgtaaatgactggattttaagcccttcctgctcctcccagacaaccgcccagcggngcctggggtgagcttacacactgaagagctgcagaagctttgc

SEQ ID NO: 50187 - DNA, 330 bp, Homo sapiens
aaaaatgactttactgaagaggaggaagcccaggtaccgcaaagagaaccagtggtgtgaagagaagtgaaatgtttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggt

SEQ ID NO: 50188 - DNA, 515 bp, Homo sapiens
  misc_feature 5: n = A,T,C or G
gtggnaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagtctggctaactttggaatccattagagaaaaatccttgtcaccagattcatacaa

SEQ ID NO: 50189 - DNA, 427 bp, Homo sapiens
  misc_feature 63: n = A,T,C or G
atgtgtcacctgaccgtgcgaatcaattctgcgaaacttgtatctgttttaaagaaggcactngaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctgggattgaaagggagtgcctatctatatttagcaagagacactattaccaaagattgttggttaggccagattgacacctatttataaaccatatgcgatatttttctgtgctatatatgaaaaataattgcatgatttctcattcctg

SEQ ID NO: 50190 - DNA, 243 bp, Homo sapiens
cctcacatttggatgattgtcataaggtttttagcatgttcctccttttcttcaccctccccttttttcttctattaatcaagagaaacttcaaagttaatgggatggtcgggatctcacaggctgagaactcgttcacctccaagcatttcatgaaaaagctgcttcttattaatcatacaaactctcaccatgatgtgaagagtttcacaaatccttcaaaataaaaagtaatgacttagc

SEQ ID NO: 50191 - DNA, 352 bp, Homo sapiens
  misc_feature 47, 137: n = A,T,C or G
ggagaacacggaaagagaactgccgtcctgatggaagagagcttggngaattcagaaccacaactgtcaacatcggttcaattagtaccgcagatggttctgctttagtgaagttgggaaatactacagtaatctgnggagttaaagcagaatttgcagcaccatcaacagatgcccctgataaaggatacgttgttcctaatgtggatctaccacccctgtgttcatcgagattccggctggacctcctggagaagaggcccaagtggctagccagttcattgcagatgtcattgaaaattcacagataattcagaaagaggacttatgcatttctccaggaaagcttgct

SEQ ID NO: 50192 - DNA, 414 bp, Homo sapiens
  misc_feature 30, 39, 60, 365: n = A,T,C or G
gataagaaaggcatagacatttattagatnagacatgtncaataaattgcagaacacggnatctctcaccaattcctctataaatttaacctttagcagcacatttttccaattcattgtcaagttaatctatatagtcagagttcctaattatgtttacattactgacatacaccaaatggaaaattagagatatcttatccctagttataagttgtaagtaaatacttgctggtatactataacactatttaaaattttaaccatgaggaaaagagttgtttttggaatgactttaaatagaagtgcattaagaaatataatttgaaccagagaaaaagttagatttacttagtatttttggngactgtgttaaaactacaaatagcagtatattttcccagtttcaaagag

SEQ ID NO: 50193 - DNA, 429 bp, Homo sapiens
aaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgcttatttccacatttaaactacctgttaatataagggatttgtagtatcagcttggtgagcaatgactttgaatctagttttcagtgatcagaagcagcaggtatttgagtgtatgaatggaatgatgatcactggctataatgtactgaaaccaccatattacagaaatatttactacatattttccatctgaggttctcagaaggctatggataagtt

SEQ ID NO: 50194 - DNA, 424 bp, Homo sapiens
gaggaagacgcggtccgtaagggctgaggatttttggaccgcactgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattac

SEQ ID NO: 50195 - DNA, 371 bp, Homo sapiens
  misc_feature 12, 21, 320: n = A,T,C or G
cacatttaatcnttagaaagnttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgntcccagtggttgaagttatttgccaacaattttactgttctcttcatctgt

SEQ ID NO: 50196 - DNA, 176 bp, Homo sapiens
  misc_feature 20, 28, 36, 38, 47, 54: n = A,T,C or G
tattttgaagacaatgcagnagtcatantgaacaananaggcgagangaaaggntctgccattacaggaccagtagcaaaggagtgtgcagacttgtggccccggattgcatccaatgctggcagcattgcatgattctccagtatatttgtaaaaaataaaaaaaaactaaaccc

SEQ ID NO: 50197 - DNA, 418 bp, Homo sapiens
gagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcaggacatggaaccatctctgagggaccaggtggatgctgaagctcacccagtcagggcccctctcctagctccttttacactgaaattaatctgaaagctttcatagccaaggctttgcctagggtgctattattccagctggccaaagagaagcttgggccagattgggattctcaatggattttatagacataattcccctgcaaacttaaaaaaataaataacccctactttatagggactaattg

SEQ ID NO: 50198 - DNA, 365 bp, Homo sapiens
  misc_feature 300: n = A,T,C or G
tacaaccagcatgctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagtctccagcttcagctcaactcacagcttctccaagcatcaccctgggagtttcctgagggtnttctcataaatgaggctgcacattgcctgtctgcttcgaagtattcaataccgtcagtatttaaa

SEQ ID NO: 50199 - DNA, 322 bp, Homo sapiens
  misc_feature 46, 191: n = A,T,C or G
aaaaaacagccggtagacttaggtctgttagaggaagacgacgagnttgaagagttccctgccgaagactgggctggcttagatgaagatgaagatgcacatgtctgggaggataattgggatgatgacaatgtagaggatgacttctctaatcagttacgagctgaactagagaaacatggttataaganggagacttcatagcatccagaagaagtgttgaagtaacctaaacttgacctgcttaatacattctaggcagagaacccaggatgggacactaaaaaaatgtggttatttcattatctgcttggatttattt

SEQ ID NO: 50200 - DNA, 136 bp, Homo sapiens
gacgtgaaaaataccattttcacaagcatttagctatttccacctccaaaaaagtagtttttactttatctatatcttcataagcctttaaggtgaaagatgaatgacagcaacaaaatgacagtgacctaaaagc

SEQ ID NO: 50201 - DNA, 517 bp, Homo sapiens
  misc_feature 209: n = A,T,C or G
cctggcagctacattcccgctcctggcgctcagcaccgctgcccaggccgaaccggcgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggcgnggtgcatggatcctgatgggcgtcccagttcccttttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcggttctcatctctaaggcctcattgagtcggtgcatctggccaatgagctgctgagactcttgacagcacctccagctctgctgc

SEQ ID NO: 50202 - DNA, 322 bp, Homo sapiens
  misc_feature 77: n = A,T,C or G
ggaaaccgcagataagcttgtttctctttgaaagatagagattaatacaactacttaaaaaatatagtcaataggtnactaagatattgcttagcgttaagtttttaacgtaattttaatagcttaagattttaagagaaaatatgaagacttaagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatg

SEQ ID NO: 50203 - DNA, 313 bp, Homo sapiens
  misc_feature 20, 153, 161: n = A,T,C or G
aaaatctgagggaaatgttntgtaaacatttattttttttaaagaaaagatgaaaggcaggcctatttcatcacaaggacacacacatatacacgaatagacatcaaactcaatgctttatttgtaaatttagtgtttttttatttctactgncaaatgangtgcaaaaccttttactggttgcatggaaatcagccaagttttataatccttaaatcttaatgttcctcaaagcttggattaaatacatatggatgttactctcttgcaccaaattatcttgatacattcaaatttgtctgggtaaaaaata

SEQ ID NO: 50204 - DNA, 409 bp, Homo sapiens
acggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgctgtaggcggttttgtgagagtgaacactttccactttttgacaccttatcctgatgtatggtccaggatttggattttgattttccaaatgtagcttgaaattcaataaactttgctctggt

SEQ ID NO: 50205 - DNA, 181 bp, Homo sapiens
tcaaacgctgaaaacgaatcagcatttagtcttgccaggcacacccaataatcagtcatgtgtaatatgcacaagtttgtttttgtttttgttttttttgttggtggtttgtttgtttgctttaagttgcatgatctttctgcaggaaatagtcactcatcccactccacataaggggctt

SEQ ID NO: 50206 - DNA, 287 bp, Homo sapiens
  misc_feature 228: n = A,T,C or G
aaaaatacattcaaaatgtactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggnctagagaactgatgtttcaatttacccctctgctaaataaatattaaaactatcatgtg

SEQ ID NO: 50207 - DNA, 249 bp, Homo sapiens
gaacttgcagactctgcgcttgagatcttcaaacaagcatcagcgttttccaggcttcccagaggtctgtgcgactagcccctgtctatcaaaagttattagagaggatgaagcattagcttgaagcactacaggaggaatgcaccacggcagctctccgcaatttctctcagatttcacagagactgtttgaatgttttcaaaaccaagtaccacactttaatgtacatgggccgcaccataatgaga

SEQ ID NO: 50208 - DNA, 291 bp, Homo sapiens
  misc_feature 15, 18, 33: n = A,T,C or G
gtgcagataaccacnganggccagatatctggngaaaaccagcagcatcagatagggctaagatgaaaaaagaaagtcatagaccaacaaaaacaggttatttagggaagaaaaattttaaaaaattctagttaatgtcctcagagattgatgaaagaatggtatctataaagaaagtacacggttttatgcaaaaagagaacaagaggaaattaaaaatatgattgcccctccctccctccattcaataaaaggctaggtttaaaagtagagcaaacagacaaagtaact

SEQ ID NO: 50209 - DNA, 262 bp, Homo sapiens
  misc_feature 32, 37, 87, 126: n = A,T,C or G
cttaaagacaacttcagggggtaattataaangttgngttacttcgtcctaaattaaatggatagaaagatttaaaatgtgttttgnttctactattcagaaactgcgaactagggaaaggttggnatgaaaaaatgtctttccttttttcaatgtacatagttcaactctttctttgttacatttaaactatatccatggatatcagtctgctttggactcctctgctagtgttacagatggaaataaaaccattaattcg

SEQ ID NO: 50210 - DNA, 407 bp, Homo sapiens
  misc_feature 47, 77: n = A,T,C or G
gatgagctgcacatgtcttgggaacaggaaaaggagaattcaagtgngaccctcatgaggcaacgtgttatgatgangggaagacataccacgtaggagaacagtggcagaaggaatatctcggtgccatttgctcctgcacatgctttggaggccagcggggctgcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgg

SEQ ID NO: 50211 - DNA, 455 bp, Homo sapiens
  misc_feature 286: n = A,T,C or G
ggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggngaattctttttaccaacccacgagttgccacttcccaatgccggggatctgacacctacctggcaatgacctccacagccgttccctctgttggatcttccagcttattctcaacagttcattttaggtcacattcttgaccgaatctcagagctcaggtaatctttta

SEQ ID NO: 50212 - DNA, 393 bp, Homo sapiens
atggttcctggcaagcccatgttgtgtttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcaagtggtggaagaacggctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagttttt

SEQ ID NO: 50213 - DNA, 416 bp, Homo sapiens
  misc_feature 33: n = A,T,C or G
ggcaaatctgagcgttctcaacttggttattgnaaaaaaaggagagaaggatattcctggactgactgatactacagtgcctcgccgcctggccccaaaagagctagcagaatccgcaaacttttcaatctctctaaagaagatgatgtcccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttgccaagagaatgaaggaggctaaggagaagcgccaggaacaaattgcgaagagacgcagactttcctctctgcgagcttctacttt

SEQ ID NO: 50214 - DNA, 410 bp, Homo sapiens
  misc_feature 161, 353: n = A,T,C or G
atgtcatgggacaaattacctttgtttctcacccttctaatcacagttggggagttatgggagatgctgaactggaattctgatattgggcagtgtgctcttctctgggaaactagaagttgtttttctgccagaggaatgacacagtgatgatttccctnggttttctttttgccacatacccgagactgggtgctagagaaacaggcaacctagaaaggcaacaggcacagaaaaagaaagtcttctagccagagaaccaggaaataggcaggtcagaacagtgttcgcaagccagaacactcttagaaagtaaccattctactgtagccaaacatcacagaaaaaattgnggtctgcttccacaatccccagcagtaatgaagtagcaccctaccaccaccattccc

SEQ ID NO: 50215 - DNA, 314 bp, Homo sapiens
gaccaggaattctttgtggacattggccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaattttttttcaacactcttacacctgttatggaaaatgcaacctttgtaagaaaacc

SEQ ID NO: 50216 - DNA, 138 bp, Homo sapiens
  misc_feature 14, 20: n = A,T,C or G
gcctgtgggacagnccaggncagcagagctgggatgtggtgcatgcctttgtgtacatggccacagtacagtctggtccttttccttccccatctcttgtacacattttaataaaataagggttggcttctgaactac

SEQ ID NO: 50217 - DNA, 342 bp, Homo sapiens
gataaatataccaagttgaaaatatttgaaatatagttgttgtttaaggattgcaaaacagttttaatgctactttcattttttatcacttccacagtaagtacaggaatcatttctttgctgcttcaatgttgtcatcagtaggtggtaattataatatattcctgtccatttacaggaagtattgtgaaaacaaattacattatttgacaaaagtcacagagccaataagtctcagtgccaagaatcaaatctcggctttgagtagaaaaggcactgaagagagaagtacctttgacataaggccacttcctttctaatcttttctttgagtgggagagt

SEQ ID NO: 50218 - DNA, 387 bp, Homo sapiens
ggacagcagctggttgagatacatccccatctggagacaggactgccattgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgctttttaatgatgacctaactttattcaacccatcggaatt

SEQ ID NO: 50219 - DNA, 151 bp, Homo sapiens
ggtaatgaaaatggtacttgtttggattaaaaaacaaattaagtccaaatagtgattaggcaagttggtgaggtagggggttgctgcaagagcggaagttgaaagatcttggaaaaattaaagaaacttcatagaaccccatctctacacc

SEQ ID NO: 50220 - DNA, 269 bp, Homo sapiens
  misc_feature 4, 10, 20, 53: n = A,T,C or G
gcanaatagngggaagattnataggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 50221 - DNA, 440 bp, Homo sapiens
  misc_feature 35: n = A,T,C or G
ctggcaaaaccatcacccttgaggtcgagcccagngacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgccagaaatacaactgcgacaagatgatctgccgcaagtgctatgctcgccttcaccctcgtgctgtcaactgccgcaagaagaagtgtggtcacaccaacaacctgcgtcccaagaagaaggcaaataaggtgtctttccttgaagggcagcctcctgcccaggccccgtggccctggagcctcaataaagggccctttcattgactgg

SEQ ID NO: 50222 - DNA, 425 bp, Homo sapiens
cgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaccaggaagaaaaggtatttctttaaatccagaacaatggagccagctgaggaacagattctgacattgatgatgcagtaagaaac

SEQ ID NO: 50223 - DNA, 249 bp, Homo sapiens
agtgaagatagcgatgaagagattgaagaactgaataaattgcaggcattacaggaaaaaagaataaatgaagaagaggaaaagaaaaaagaaaaaagcaaagaaaaaatcaaattgaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacg

SEQ ID NO: 50224 - DNA, 148 bp, Homo sapiens
  misc_feature 132: n = A,T,C or G
tgtaggtaattggcagattctaaataatataatttccagatagtaattttaagagtactcatcgctcttgccaaataagttcagggtattcaaatcttggactagtcctgcaaggtacaaagaataaaaatnccagtgagatacttgg

SEQ ID NO: 50225 - DNA, 317 bp, Homo sapiens
  misc_feature 176: n = A,T,C or G
atgatagaacttaaaagaaatgtgcatttgttttcatagccccagcagagaaaatcctcttcatagattaaatgtgctgctgtggacaggagggaaaaaaaaaccctctacatattgaaaggcaccaaatgtaatatctgacactgttaagatgcccaaaagagcaaagttgtagnggagatgcagggtcatttccccatgccatccacagtgtttgttagtgagtccacggctgacttgcagtgataaagaaaagcatggagctgtgctgcagacaatgggggctcatctgtaagtggcttcagaggcagcagccc

SEQ ID NO: 50226 - DNA, 332 bp, Homo sapiens
tctcacaacgaactggctgatagtggaatacctggaaattctttcaatgtgtcatccctggtgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcggcatctcagaaaccagtcttccaccggatatgtatgaatgtctacgtgttgctaacgaagcactcttaattaatatctgatcctgggacaatattta

SEQ ID NO: 50227 - DNA, 446 bp, Homo sapiens
  misc_feature 13, 23, 46, 48, 62, 230, 231, 242, 245: n = A,T,C or G
ttaaagtatgatncgatataatnttattgaaattaccttatcatgncntagagcccgacttnatgtttaaaactaatttcttaaaataaagccttcagtaaatgttcattaccaacttgataaatgctactcataagagctggtttggggctatagcatatgcttttttttttaattattacctgatttaaaaatctctgtaaaaacgtgtagtgtttcataaaatctgnnactcgcatttnaangatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactga

SEQ ID NO: 50228 - DNA, 385 bp, Homo sapiens
  misc_feature 21, 26: n = A,T,C or G
agctaaaagtagacaacaggnatgangacttgaaagatgatgatgaaatactttggacaatacaatgagaaaactaatatcttaaaaactatttagttatttttagcatagttgagaataatgaattataaataatgaattataaataatgaactattaaaaactattaaaaaacaacagtttttacatttgtttcaaaatgtagggaaaaaatacgctcactaggattccatcatatttcttagatttataagagttcagtggactcatttgataattgcaagatagcatgagttttagtctgttcttttaaaaaataagtttctctttgtctttggaagacttttaagaaagaataaaagtaatgacatctcaatcctaacaa

SEQ ID NO: 50229 - DNA, 355 bp, Homo sapiens
gaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgg

SEQ ID NO: 50230 - DNA, 392 bp, Homo sapiens
tgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacgcacacatatacacgaatagacatcaaactcaatgctttatttgtaaatttagtgtttttttatttctactgcaaatgatgtgcaaaaccttttactggttgcatggaaatcaggccaagtttataatccttaaatcttaatgttcctcaaagcttggataaaatacatatgg

SEQ ID NO: 50231 - DNA, 266 bp, Homo sapiens
  misc_feature 135, 194: n = A,T,C or G
ccctcagcacacagaggatgatgctgactttgatgaagtccaatatcagatggaaatgatgcggagccttcgcatgtaaacattgatcatcttcacgtgggctggaatcaagtccacatactatggctcattcgntacccggcactcctggactctcagtttagttaccagcatgccattgaagaatctggcgntctcatttatgatcccataaaaactgcccaaggatctctctcactaaaggcatacagactgactcctaaact

SEQ ID NO: 50232 - DNA, 220 bp, Homo sapiens
  misc_feature 46: n = A,T,C or G
ctaatcttgtcaaccagtgcaagtgaccgacaaaattccagttatntatttccaaaatgtttggaaacaagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 50233 - DNA, 278 bp, Homo sapiens
  misc_feature 34: n = A,T,C or G
gttgtaactttagtaaactaagtggtatacagangcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctatt

SEQ ID NO: 50234 - DNA, 449 bp, Homo sapiens
  misc_feature 11, 17, 43: n = A,T,C or G
agacgaggtcnacgatncctcccttaccatcaaatcaattggncaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaataggacccgtatttaccctatagcaccccctctaccccctctagagcc

SEQ ID NO: 50235 - DNA, 356 bp, Homo sapiens
  misc_feature 311: n = A,T,C or G
gaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaancatgacccgagaggtgcagacaaatgacttgaaagaagggggcaa

SEQ ID NO: 50236 - DNA, 250 bp, Homo sapiens
tgttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgat

SEQ ID NO: 50237 - DNA, 350 bp, Homo sapiens
  misc_feature 8, 13, 25, 28, 48, 52, 58, 73: n = A,T,C or G
tgttattnaaaantggcagaaatgnganatcttgaaacattattcagntaanggaagnagagagactcttggntgtcataatattgtctggaatttttaaaaagcaatttataaagatactagtttcttaaattacagctccctgtaatttgtatactcaggtttagattcacctactctgaaatcatggtggtaggtagtcattgagctgttctgtaaggcaagtgcaagaatttaggaagttccatttaatttagcctttgtgaaaaaattctactttttgtatgaattgtgtgccccacccccactcccaaatattagctccacaaaggcagaattttatctctcta

SEQ ID NO: 50238 - DNA, 467 bp, Homo sapiens
  misc_feature 399, 433: n = A,T,C or G
ctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttgggtgaaggaagaagtggggtggaagaagtggggtgggacgacagtnaaatctagagtaaaaccaagctggcccaaggtgncctgcaggctgtaatgcaggttaatcagaggcca

SEQ ID NO: 50239 - DNA, 334 bp, Homo sapiens
  misc_feature 312, 326: n = A,T,C or G
gggagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggcaattcgattttaatttctcaaaagatctctgttatccagaagatnaaaatgcctacatngagtgctt

SEQ ID NO: 50240 - DNA, 320 bp, Homo sapiens
actatacaggcatataaaaaaatgagatcacgtcctctgcagcaacatggatggagctggaggccagtatcctaagtgaactaatacagaacagaaaaccaaatactgtatgtgctccctataagtaggagctaaacactgagcacacatggacaaaaagaagggaataataggcaccagggcctatttgagggtggagggtgggaggagagcgagaactgagaaaatacctatcaggtactatgcttattacctgggtgacaaaataatctgtacaccaaaccccatgacatgcaatttacctatataacaaacctgcg

SEQ ID NO: 50241 - DNA, 176 bp, Homo sapiens
  misc_feature 11: n = A,T,C or G
ttaaagtatgnaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtct

SEQ ID NO: 50242 - DNA, 391 bp, Homo sapiens
gatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaatcgttcaaccaattatcagcaaactctatggaagtgcagccctcccccaactggtgaagaggatacagcagaaaaagatgagttgtaggacactgatctgctagtgctgtaatattgtaaatactggactcaggaacttttgta

SEQ ID NO: 50243 - DNA, 263 bp, Homo sapiens
  misc_feature 8: n = A,T,C or G
ggccacanatatgcgaatctataagaaaggtgatattgtagacatcaagggaatgggtacttgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcag

SEQ ID NO: 50244 - DNA, 299 bp, Homo sapiens
  misc_feature 38: n = A,T,C or G
ggtgaagtaaaatgaacatttttgggccggcgcagtgnctttacgcctgtaatcccagcactttgggaggccaaggctggtggatcacctgaggtcgggagttcgacaccagcctgaccaacatggagaaaccccgtctttactaaaaatacaaaatgattcaggtgtggtggcgcatgtctgtaatcccagctacccaggaggctgaggcagaatcgcttgaacctgggaggcagaggttatggtgagctgagattgcaccattgcactccagcctgggcaacaggagttaaattttg

SEQ ID NO: 50245 - DNA, 421 bp, Homo sapiens
  misc_feature 27, 28, 40, 141: n = A,T,C or G
gagacatgtaagcagcatcatggaggnntgaagatgccgnatttggattggatgaattccaaattctgcttgcttgctttttaatattgatatgcttatacacttacactttatgcacaaaatgtagggttataataatgntaacatggacatgatcttctttataattctactttgagtgctgtctccatgtttgatgtatctgagcaggttgctccacaggtagctctaggagggctggcaacttagaggtggggagcagagaattctcttatccaacatcaacatcttggcagatttgaactcttcaatctcttgcactcaaagcttgttaagatagttaagcgtgcataagttaacttccaatttacatactctgcttagaatttgggggaaaatttagaaatataattgacaggga

SEQ ID NO: 50246 - DNA, 356 bp, Homo sapiens
aaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgt

SEQ ID NO: 50247 - DNA, 240 bp, Homo sapiens
  misc_feature 78: n = A,T,C or G
cggtggctcaccctccgcaagaccttgctggtgcagacgaagcggcgggctctggagaagattgaccttaagttcatngacaccacctccaagtttggccatgccgcttccagaccatggaggagaagaaagcattcatgggaccactgaagaaagaccgaattgcaaaggaagaaggagcttaatgccaggaacagattttgcagttggtggggtctcaataaaagttattttccactg

SEQ ID NO: 50248 - DNA, 262 bp, Homo sapiens
  misc_feature 199: n = A,T,C or G
aaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgtngtctgacttactgtttcaacaaaccagaagacaagtaactgtatgagttaataaaagacatga

SEQ ID NO: 50249 - DNA, 395 bp, Homo sapiens
  misc_feature 37, 50: n = A,T,C or G
ctgaaaggtcacttctgaaacataaaatctctgtaanctattaacataanttgtgctgttcaaacaaatttaagccaatcattgagagaggtaaactctattttagcatctgctgcagaatgtcttttctcaaaatatttacacttccaatgttatttctgtacattactgctcaaaccagatattcaaaacaaaacagattcttaacaaacaggttttgcccaagtcttacaactctgcaataatatgtgtaatagaaaaatagacagtaattgaaaagtttatgtttttcttgtcttccagccactaaagtacctctgttcaaaatcactatacgggtttaggctaattacaatctatacgtctgtattttaaaataaaatgttatactttct

SEQ ID NO: 50250 - DNA, 498 bp, Homo sapiens
cctcacaacagcccggaagagaggtggtgatgattatctttagaaatgaactcagactataaatgtatagttcagtctccatgagaaggaatgaaattaatgatctgttatttctcccaaataacctggtatggtttcaaagactctgactgactgtattcaaattccataaggcattggaatccttcccataggaatagctgtcatcgtctcaactgatttgatccccttccccttcacccagccctgttgccgggagcggtaacacagtaacttggagctgatggcactatgttcagctccacttggaaacattaatcacaggttgacaggaataagataagaataactgcatttgagtgtgctcttaaagatatatttatgggcattttggttggacgcatcaacttagtgaatctttttctaatctaatttaggccttgaagaggacctgagagagaaggaaagagaaattgctacagagaagaaaaatagtct

SEQ ID NO: 50251 - DNA, 358 bp, Homo sapiens
tctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcaggcatcatggaggtttgaagatgccgcatttgga

SEQ ID NO: 50252 - DNA, 141 bp, Homo sapiens
  misc_feature 15, 42, 86, 93, 123: n = A,T,C or G
ggaggcttctgaganacagcaacctctctcctgattggggtngccatgagatttctctagctatatccaacttggcatctgtacancatcttnggaggaacatcttatttgtggaaggacctngacaagccgtttgagatg

SEQ ID NO: 50253 - DNA, 105 bp, Homo sapiens
catcagagggaacaggcaacctacagaatgggagacaaattttgcaacctatccacctgacaaatggctgataccagaatctacaaggaacttatacaaatttac

SEQ ID NO: 50254 - DNA, 341 bp, Homo sapiens
cctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagc

SEQ ID NO: 50255 - DNA, 314 bp, Homo sapiens
  misc_feature 85, 228: n = A,T,C or G
agatgttttctctttgaaagataggagattaatacaactacttaaaaaatatagtcaatagggttactaagatattgcttagcgntaagtttttaacgtaattttaatagcttaagattttaagagaaaatatgaagactgtagaagagtagcatgaggaaggaaaagataaaaggtttctaaaacatgacggaggttgagatgaagcttcttcatggagtaaaaaangtatttaaaagaaaattgagagaaaggactacagagccccgaattaataccaatagaagggcaatgcttttagattaaaatgaagg

SEQ ID NO: 50256 - DNA, 358 bp, Homo sapiens
gcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttataccggaaaaaattgtattgaaaacacttagtatgcagttgataagaggaatttggtataattatggtgggtgattattttttatactgatgtgccaaagctttactactgtgggaaagacaactgttttaat

SEQ ID NO: 50257 - DNA, 428 bp, Homo sapiens
agagaagtgggaccgtcaggaagaaaatggccagatgatgagctgcacatgtcttgggaacggaaaaggagaattcaagtgtgaccctcatgaggcaaccgtgttacgatgatgggaagacataccacgtaggagaacagtggcaggaaggaatatctcggtgccatttgctcctgcacatgctttggaggccagcggggctggcgctgtgacaactgccgcagacctgggggtgaacccagtcccgaagcactactggcagtcctacaaccagtattctcagagataccatcagagaacaaacactaatgttaattgcccaattgagtgcttcatgcctttagatgtacagctgacagagaagatcccgagagtaaatcatctttccaatccagaggaacaagcatgtctctctgcaagatccatct

SEQ ID NO: 50258 - DNA, 292 bp, Homo sapiens
ctcacatgggagttgtcctcacccttggtaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaggct

SEQ ID NO: 50259 - DNA, 484 bp, Homo sapiens
  misc_feature 50, 63, 69, 411: n = A,T,C or G
aagcttcatcaagccatgaaggtgttggaactcgccataaggcattgatnaggattatggttncccgtnctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccntatacaagttgttctagtaacaatacatgagaaagattctatgtaggctgaaaataaaatgacgtcacaaggc

SEQ ID NO: 50260 - DNA, 349 bp, Homo sapiens
  misc_feature 9: n = A,T,C or G
gcagaaagnggaccagtgtgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgattcacaaaaagatttctgaagacagagctcctcaaaccattgtggatatcttctgccttcaaccacagatcaaatacttcaagagccatttaataaatatggcagaactacg

SEQ ID NO: 50261 - DNA, 380 bp, Homo sapiens
ctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaa

SEQ ID NO: 50262 - DNA, 339 bp, Homo sapiens
ggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatc

SEQ ID NO: 50263 - DNA, 358 bp, Homo sapiens
  misc_feature 24, 37, 46, 107, 109: n = A,T,C or G
caaagcgaactactatactcaatngatccaataactngaccaacgnaacaagttaccctagggataacagcgcaatcctattctagagtccatatcaacaatagggntnacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggctacttcacaaagcgcttcccccgtaaatgatatcatctcaacttagtattatacccacacccacccaagaacagggtttgtt

SEQ ID NO: 50264 - DNA, 244 bp, Homo sapiens
  misc_feature 26, 31, 47, 53, 57, 58: n = A,T,C or G
caacaacaagcttaccagagtacctngtggnctggcagaggataagnacatcnaggnngtctaccttcataacaacaatatctctgtagttggatcaagtgacttctgcccacctggacacaacaccaaaaaggcttcttattcgggtgtgagtcttttcagcaacccggccagtactgggagatacagccatccaccttcagatgtgtctacgtgcgctctgcattcaactcggaaactataa

SEQ ID NO: 50265 - DNA, 389 bp, Homo sapiens
  misc_feature 31: n = A,T,C or G
aaaagccatcaccaagaagaagtatattggnatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactct

SEQ ID NO: 50266 - DNA, 377 bp, Homo sapiens
  misc_feature 355: n = A,T,C or G
tatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggattcagttttaacaaatgctattaaagtggagaagcacactctggncttggaatccatttgaggatta

SEQ ID NO: 50267 - DNA, 270 bp, Homo sapiens
gctcaagccttgtaatcccagcactttgggaggcccaggtgggcggatcacaaggccaggagatcgagatcatcctggctaacacggtgaagccctgtctctactaaaaatacaaaaaaaattagccgggcgtggtggcgggcgcctgtagtcccagctacttgggaggctaaggcaggagaatggcgtgaacctgggaggtggagcttgcagtgagccaagatggtgccactgcactccagcctgggcaacagaatgagactctgtccc

SEQ ID NO: 50268 - DNA, 133 bp, Homo sapiens
  misc_feature 125: n = A,T,C or G
gacatggcccgcagtggctttttgccccagaaaggggaaaggaacacagcgggtagatgatttctagcaggcaggaagtcctgtgcggtgtcaccatgagcacctccagctgtactagtgccatnggaataat

SEQ ID NO: 50269 - DNA, 218 bp, Homo sapiens
  misc_feature 59: n = A,T,C or G
ataacttgaccaacggaacaagttaccctagggataacagcgcaaacctattctagagnccatatcaacaatagggttactgacctcgatgttggagcaggacatcccgatggtgcagccgctattaaaggttcgtttgttcaacgattaaagtcctacgtgatctgagttcagaccggagtaatccaggtcggtttctatctacttcaaattcctcc

SEQ ID NO: 50270 - DNA, 475 bp, Homo sapiens
  misc_feature 48, 417, 431: n = A,T,C or G
agagagcggaggtggtggcggcggaggctttggcagctcgggactgantgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccagcctgaagaaataaagtaaaattaatctggtaattngcacggattagtgnacactagttagaagttcagaataaacatgcatttcataactggc

SEQ ID NO: 50271 - DNA, 275 bp, Homo sapiens
  misc_feature 272: n = A,T,C or G
agaggcagatctggagaagattaaaaaaaaatctcaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcgaaaccctgtctctactaaaancgc

SEQ ID NO: 50272 - DNA, 157 bp, Homo sapiens
  misc_feature 23, 49: n = A,T,C or G
caaaaattagccaggcatggtgncacacggcctatagtcccagctactnaggaggctgaggcaggagaatcacttgaacccaggaggcagaggttgcagtgagctgagatcacgtcattgcactccatcctgagccacaagagcaaaactccgtctc

SEQ ID NO: 50273 - DNA, 276 bp, Homo sapiens
  misc_feature 237: n = A,T,C or G
ttatgtttactgtgatacacaatttactggagagatgaactgcccacatgcagattaacatcacacggtgttttaagcggatactcacaacacttgagctcactgcaatagcaacaggaggtggttatgaaattattgtagtactacagtatgtactacagctaatcttatgcatttatgatttaaaactgcatctttacatgtgtttactttttcccaattgtgaatggtgcatgnacatctgtgcttgtgcaagttttgataaattttaacttt

SEQ ID NO: 50274 - DNA, 109 bp, Homo sapiens
  misc_feature 13, 26, 82, 84: n = A,T,C or G
tcctatgtaaaancatactatgtatntttgacattaatgttgaaatcaaatatatgcacaagtctttaattttgtgtaatgngntaagtgctgttcatttaagttatcg

SEQ ID NO: 50275 - DNA, 360 bp, Homo sapiens
atgtactaagagtgtgctctgtaacaatcatatatttagatttagaaagatttgacccaacactcttgtcctaggaggatatcaaatatcactggtgttggaggtggcttagctaggacatcttaacatattctcctacacactagactcccatgagtagggctatgtgtttgggtgaggaggtgtgcacatgaccacaagtgcccccatgttgtgctttaattcaactatgcttatatttcggattgatttactccccttaggagattctaattgataacaatggaatgttaatgtgacttaaaaataattccacttgtatctatttgaagtctcttctctcccctcgttttgattttc

SEQ ID NO: 50276 - DNA, 430 bp, Homo sapiens
  misc_feature 404: n = A,T,C or G
cgttggtcctgtgcggtcacttagccaagatgcctgaggaaacccagacccaagaccaaccgatggaggaggaggaggttgagacgttcgcctttcaggcagaaattgcccaggtgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctggggaccaaagcgtcatggaagctttgcaggctggngcagatatctctatgattggccagtc

SEQ ID NO: 50277 - DNA, 340 bp, Homo sapiens
  misc_feature 59, 104, 200: n = A,T,C or G
gcctttaattcagaggattatctaagctctttaaagctgtttttctccattgtcatagngccttctctgaaaaatgaatgtacaggtatcctattttctaatgnaattaggattttttaaaagcaatttttgatagtttttcttttaaaaagtaaaattcagcactgtgacttgaacccccaaatctttcacatacaggngaaacattaagccacaaataaaaataatgaacaagaaagaagacaagatcctaattcctgcattagtgacctaagtaccccatatcagaaactttgcaaaacagatctagggcagaaggctttgaaagacatttttcttt

SEQ ID NO: 50278 - DNA, 376 bp, Homo sapiens
gaaaaagggccgttctgccatcaacgaagtgtaacccgagaatacaccatcaacattcacaagcgcatccatggagtgggcttcaagaagcgtgcacctcgggcactcaaagagattcggaaatttgccatgaaggaggtgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggacgagaactaatcgctggatcgcagatcaaataaagtta

SEQ ID NO: 50279 - DNA, 426 bp, Homo sapiens
  misc_feature 376: n = A,T,C or G
catactaaaataaatatttccaaagcactattgcctctgcaaaattatgataagagtaaaaatagtggactgccactggaaaccccaagagcaggaaatttataatagaggattcatgctggaagtattaaaggttgtttatagacctaagtggttaataaggatgtgtgtattgatattgctttagttaactccaacttgtaaccaattttattagcaataaagtctcacaatgacttagaaaactcactgcacatacgaacttccaagcatcacacctactacctaggagggaagtacctacctacttccaagcatcacaccactctagtgactaaaattcataaagtaaaaggaaaataatgaaataagttgnaaagtaggaaaccgtggaagatcatagatgtgacatagaatagtgtagat

SEQ ID NO: 50280 - DNA, 366 bp, Homo sapiens
gaccacaccagagcctcagcctcggtccttctcagccgtcgggataggatccaggcatttcttttaaatctcagaggtagcagtaaacttttcagtattgctgttagcaagtgcgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattatt

SEQ ID NO: 50281 - DNA, 226 bp, Homo sapiens
  misc_feature 29, 40, 150: n = A,T,C or G
aaggcgatcaaggccaagtatccgccagncaataggaagnactgagtatttggatcatacagcagatgtccagtggggagaagaattttcattgtccaagcaccctcagggaacagaagtcaaagcaataacatattcagcaatgcaggnctataatgaagagaacccggaagtttttgtgatcattgacatttaagacaccaaaaaataaaagactcctacgatg

SEQ ID NO: 50282 - DNA, 443 bp, Homo sapiens
  misc_feature 26: n = A,T,C or G
atcccacaaaagtgctgcagatgatnacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgcagaaatttgaaaaaatatctgagtctgcaaaacaagaacttataggattttaagacaagaagagttgctgcattcagaaaaaaattaggtggaactggcagagtag

SEQ ID NO: 50283 - DNA, 440 bp, Homo sapiens
  misc_feature 358, 425: n = A,T,C or G
cctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggccttccctttgcctgtggngtaaaagtgcatcacacaggattgctttttaacaagaactgatgctccttggtgctgctgtactcanctagctctaagggat

SEQ ID NO: 50284 - DNA, 401 bp, Homo sapiens
  misc_feature 348: n = A,T,C or G
ctttcctttccaagaggaatcctcgcagataaactggactgtcctctacagaaggaagcacaaaaagggacagtcgggaagaaattcaaaagaaaagaacccgcgagcagtcaaattccagagggccattactggtgcatctcttgctgatataatggccaagagggatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtgnaaaacgctaaactggcagattagatttttaaataaagattggattataactcc

SEQ ID NO: 50285 - DNA, 379 bp, Homo sapiens
  misc_feature 20, 24, 105: n = A,T,C or G
atgaaagatccaatgccccngaantgaaatagcttttttctctgatacagaaaagttgaattttacatggctggagctagaatttgatatgtgaacagttgtgtntgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggtttaaagcttccattgttgctgcaactctgaagggtaattatatagttacccaaattaagagagctatttacggagctcaaatacgtgggcattcaaatg

SEQ ID NO: 50286 - DNA, 268 bp, Homo sapiens
  misc_feature 175, 199, 207: n = A,T,C or G
aaggcaagaatgactattatttattgtacatttgataagacaatttttggaattttgaattgcacaaattacatgatatcttttgcatttatgttactatattgtacttctgacaaatctttattcctgggtggtatttttaagatatctttacctataaaaagtgtttaaggtncataggactcgacaagagctatcnggtgattntctcattagtaacatgcaacgttgtactgcaaaatttcaatcaacatgcacttataatgag

SEQ ID NO: 50287 - DNA, 342 bp, Homo sapiens
  misc_feature 18, 63, 69, 71: n = A,T,C or G
gatccccctctttgtgtntattggaactggagctactggagcaacactgtatctcttgcgtcnggcatngntcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttgggagactctattggaatccctattg

SEQ ID NO: 50288 - DNA, 482 bp, Homo sapiens
  misc_feature 11, 32, 43, 50, 51: n = A,T,C or G
aacctgctcgngagctatttccccaagaaganttctgagctgnatgcatnnttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaa

SEQ ID NO: 50289 - DNA, 413 bp, Homo sapiens
  misc_feature 27: n = A,T,C or G
tgaagctgacagcattcgggccgagangtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgactacactgaattcacccccactgaaaaagatgagtatgcctgccgtgtgaaccatgtgactttgcacagcccaagatagttaagtgggatcgagacatgtaagcagcatcatggaggtttgaagatgccgca

SEQ ID NO: 50290 - DNA, 354 bp, Homo sapiens
  misc_feature 94, 106, 128: n = A,T,C or G
tgcaaacaaacaggatttgccaaatgctatggccatcagtgaaatgacagataaactagggcttcagtctcttcgtaacagaacatggtatgtncaagccacttgngcaacacaaggaactggtctgnatgaaggacttgactggctgcaaatgagctttcaaaacgttaaatgaaattggatatctaaccaaggacatgtttgataaaattggtctaggcttgttacaacaaaattagtttgtatcttggttattaaacagtatctgggactggttgggcagaatattaaacttattttgttgccaattattggttaccgagtataatgttgctatttagcaatgtgcttggt

SEQ ID NO: 50291 - DNA, 222 bp, Homo sapiens
aatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagcgc

SEQ ID NO: 50292 - DNA, 341 bp, Homo sapiens
ttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtaggaagctaagtagaacacttagtttggggtgcaattttctatcaacgcaaacaccttagggtacccagaccaattttatgtatatatattctgaaatgctccctttttaatgtggcat

SEQ ID NO: 50293 - DNA, 305 bp, Homo sapiens
  misc_feature 76, 83, 103, 110, 195: n = A,T,C or G
aaactacctcaaaacactttcccatgagtgtgatccacattgttaggtgctgacctagacagagatgaactgaggnccttgtnttgttttgtacataatacanaggtgcnaattaatagtatttcagatacttgaagaatgttgatggtgctagaagaatttgagaagaaatactcctgtattgagttgtatcgngtggtgtattttttaaaaaatttgatttagcattcatattttccatcttattcccaattaaaagtatgcagattatttgcccaaagttggcctcttcttcagattcagca

SEQ ID NO: 50294 - DNA, 357 bp, Homo sapiens
  misc_feature 7: n = A,T,C or G
tcaacancattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacgg

SEQ ID NO: 50295 - DNA, 273 bp, Homo sapiens
ccagaagaggagaagaggaaacacaagaagaaacgcctggcgcagagcccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 50296 - DNA, 459 bp, Homo sapiens
  misc_feature 44: n = A,T,C or G
tgagctttctggctgcaccagcatgaagacataccgagctaaantctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacgtggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagctatcaaccccagacactggtttgaagaatgttaagacttgaca

SEQ ID NO: 50297 - DNA, 423 bp, Homo sapiens
  misc_feature 170: n = A,T,C or G
ggttataacttatggacgatctattgcttttcatagttgcagtaagtttggacccaattaaatcctctgaagctcctgcaaccatcaattctgcatctcttcatcctgagaaagaatttcttgttgcaggcggtgaagattttaaactttataagtatgattataatagnggagaaggattagaatcctacaagggacactttggcctattcactgtgtgagatttagtcctgatggagaactctatgccagtggttcagaagatggaacattgagactatggcaaactgtggtagggaaaaacgtatggctttggaaatgtgtgcttcctgaagaagatagtggtgagctggcaaagccaaagattggtttccagagacaacagaagaggagctagaagaaattgcttcagagaatcagatt

SEQ ID NO: 50298 - DNA, 137 bp, Homo sapiens
  misc_feature 16: n = A,T,C or G
gaaaggaatgacagcngactacaaagcaaataagatatactgagcctcaacagattgcctgctcctcagagtctctcctatttttgtattacccagctttctttttaatacaaatgttatttatagtttacaatgaa

SEQ ID NO: 50299 - DNA, 321 bp, Homo sapiens
  misc_feature 236: n = A,T,C or G
acattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggntttatttttgaaatatttattaagggaaaactaagttactgaatgaaggaacctctttcttacaaaacaaaaaaagggcagaaat

SEQ ID NO: 50300 - DNA, 173 bp, Homo sapiens
  misc_feature 54, 81: n = A,T,C or G
gcatcgtaaaaccttcagaaggaaaggagaatgttttgtggaccactttggttntcttttttgcgtgtggcagttttaagntattagtttttaaaatcagtactttttaatggaaacaacttgaccaaaaatttgtcacagaattttgagacccattaaaaaagttaaatgag

SEQ ID NO: 50301 - DNA, 378 bp, Homo sapiens
  misc_feature 9, 41, 48: n = A,T,C or G
aggatatgnagagaaaatcacatgcagctcatctaagaganatgagtncaaaagctgccgctcagctttgatggaacaacgcttattttggaagttcgaaggggctgtctgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgc

SEQ ID NO: 50302 - DNA, 307 bp, Homo sapiens
  misc_feature 84, 158, 275: n = A,T,C or G
tatatatggaattagggtaccctccctcagacttgggaagatccccatgaaaaagataagagcacgaactgctttggagataangatcctattgatgtttgcgaaataggctcaaagattctttcttgtggagaagttattcatgtgaagatccttgnaattttggctcttattgatgaaggtgaaacagattggaaattaattgctatcaatgcgaatgatcctgaagcctcaaagtttcatgatattgatgatgttaagaagtcaaaccgggntacctggaagctactcttaattggttaagatt

SEQ ID NO: 50303 - DNA, 380 bp, Homo sapiens
  misc_feature 60: n = A,T,C or G
gagataaagacactttttcaaaaatggcaatggtatcagaattcctcaagcaggcctggnttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgat

SEQ ID NO: 50304 - DNA, 432 bp, Homo sapiens
  misc_feature 11, 55: n = A,T,C or G
aattgaggttntaaaccagcttatccaaaagattcgagaagacctcccgaatctngaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatcc

SEQ ID NO: 50305 - DNA, 436 bp, Homo sapiens
  misc_feature 347: n = A,T,C or G
tttgattggagaactaaggatgtaagaattctttatattctatcctgaattctgaaaattatagtgtaaaaggatgtgcaggctgggcatggtggctcacgcctgtaatcctagcacttcgggaggtcaaggcagaggattgcctgagcttaggagtttgagaccagcctgggcaacgtggtgagatcctgtctcaaataagtaaataaaaagatgtgcagaattacattttgcataatatatggggagcagtaagatctagaatatgaaactgttgtcactctggaattatcaacatggtactctgactgaattaaatattctcaaatgagcagaacaaaacctgnatccaaaaacttaagcaaagaaatagatttaaaaaacaaaaacaatgctgtaagaaatgaagtgggaattcatcaaattcaggaaagaa

SEQ ID NO: 50306 - DNA, 333 bp, Homo sapiens
caataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgcttagacattatgaggtatacaactagtatttaagataccatttaatatgccccgtaaatgtcttcagtgttct

SEQ ID NO: 50307 - DNA, 323 bp, Homo sapiens
  misc_feature 107, 174, 210, 288: n = A,T,C or G
ggtgttacagcagtggcatttaataaggaacttgatcctatacagaaactctttgtggacaagattagagaatacaaatctaagcgacagacatctggaggacctgntgatgctagttcagagtatcagcaagagctggagagggagctttttaagctcaagcaaatgtttggnaatgcagacatgaatacatttcccaccttcaaattngaagatcccaaatttgaagtcatcgaaaaaccccaggcctgaagaaataaagtaaaattaatctggtaatttgcacgnattagttgacaactagttagaagttcagaataaac

SEQ ID NO: 50308 - DNA, 364 bp, Homo sapiens
  misc_feature 304: n = A,T,C or G
tgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgccaagctttttaggcttgtcacaaatgattgctttgttttcctaagtcatcaaaatgtatataaattatctagattggataacaggcttgcatgtttatcatgtacaatttaatattccatnctgcccaacccttcctctcccatcctaaaaaaaggccattttatgatgcattgacaccct

SEQ ID NO: 50309 - DNA, 446 bp, Homo sapiens
ttctgcgctggtcggcggagtagcaagtggccatggggatcctcagcggctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgcttgcaaagaacaagatgcgagtgaagatcaagctatctaatgattgccctgacggtggtaggatgcatcctcatggtattgaggcaagaagctgcccaaagacacgagactttaacaagcttgaacttagaaaa

SEQ ID NO: 50310 - DNA, 160 bp, Homo sapiens
gggactttgtcatcttccagaaaggaaacatattgtatatttggcccagtgtgattgattgctttatctttggtaacttttacttgaatgggatttgctggattaatgactattgaatttaaaactaattatgagttgacaaataaataaaaggtagtgt

SEQ ID NO: 50311 - DNA, 376 bp, Homo sapiens
  misc_feature 19: n = A,T,C or G
ttctggtagcaagacaatntaattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgctttttataatctcttcctttaaaaaaaaccaataaaataaaag

SEQ ID NO: 50312 - DNA, 293 bp, Homo sapiens
  misc_feature 14, 64: n = A,T,C or G
gcattatcagagcnctgccctgctcttgcatgatattatcctagattagaatgtactcttcatntttttcccatcatatggcattaataaacacaaatgaaaggagaggttatctaaaagtctattttgtatgattatttattttgcctgatggcaatgttgaagatgagatttgagcacgtggctcaggtgggtgtgacagctctataggtccctactgaccctgaggctctctgatttcatgattcagctgttgatcagattcagtgctttgcaaggtcacatcctcgact

SEQ ID NO: 50313 - DNA, 102 bp, Homo sapiens
  misc_feature 76: n = A,T,C or G
ggggaattgtgctatgaaagcagctgccaaaataagctcatttattttcttcaatcccactcagtgctcagtcacnatattctgtttccttttttttttcca

SEQ ID NO: 50314 - DNA, 103 bp, Homo sapiens
  misc_feature 33: n = A,T,C or G
gagctcttcatttattttgactgtgatttattnggagtggaggcattgtttttaagaaaaacatgtcatgtaggttgtctaaaaataaaatgcatttaaactc

SEQ ID NO: 50315 - DNA, 304 bp, Homo sapiens
  misc_feature 87: n = A,T,C or G
caaaccctgccccggctgagtctcaggagaagaagccgctgaagccctgctgcgcttgcccggagaccaagaaggcgcgcgatgcgngtatcatcgagaaaggagaagaacactgtggacatctaattgaggcccacaaggaatgcatgagagccctaggatttaaaatatgaaatggtggtctgctgtgtgcataaataattcctgaagaatgaagaagattaattttgggagttctttgacgaactttgatatgtggaaaaagtatttataatttattgtaagaagaaagtaaaatattact

SEQ ID NO: 50316 - DNA, 349 bp, Homo sapiens
  misc_feature 15: n = A,T,C or G
ttctaggtaattgtnacagaattgcttgtttgcttcaactgtctcctacctctgctcttggaggagatggggacagggctggagtcaaaacacttgtaattttgtatcttgatgtctttgttaagactgctgaagaattatttttttttcttttataataaggaataaaccccacctttattccttcatttcatctaccattttctggtcttgtgttggttgtggcagccagctgtggttttcttttgccatgacaacttctaattgccatgtacagtatgttcaaagcaaataactcctcattgtaaacaaactgtgaactgcccaaagcagcacttataaatcagcc

SEQ ID NO: 50317 - DNA, 345 bp, Homo sapiens
  misc_feature 52: n = A,T,C or G
tagcaaattcacctacacagttctggaggatggttgcacgaaacacactggngaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttgggaaacagtcaatttgacaaagaaaaatgatactt

SEQ ID NO: 50318 - DNA, 267 bp, Homo sapiens
  misc_feature 36, 59: n = A,T,C or G
tctaaagctttatctttgtgtaatctaagtatatgngagaaatcagaattggcataatntgtcttagttgatattcaaggctttaaaagtcattattcctgggcttggcaagtgaatttatgagatttactgctctagaaagtatagatggccaaaggaccgttttgtattgcttcctgattaccagtctgattataccatgtgtgctaatatactttttttgttatagattgtcttaatggaaggcaagtaataaaaagagatgaa

SEQ ID NO: 50319 - DNA, 329 bp, Homo sapiens
  misc_feature 19, 78, 101, 128: n = A,T,C or G
acagactgaaagacttgtnattttacacaatacacatggcttaattattttattgggatacagaaaaatataaattcnggacaaataagtcatatacctgntttcagtcctaacatttaaggattctngagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattaagactgataa

SEQ ID NO: 50320 - DNA, 428 bp, Homo sapiens
  misc_feature 22, 42, 55, 60, 383: n = A,T,C or G
ttaaatccatactaggagcgtnagtgagggttttcatagctnttggaaatacttnggctntgaactgtaattagcaagaagtaaaaacagaaacgtcaaacgtcaaatgtttgctttgttacctggaggactaaatgtagatgtctttagtatactttgtatgttcttaatattggaagataattttgtgaatctgtaggattttattttttcaggtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgcccatggcatagtcaaagatttgnactgctaaaattaccaaataattaaaataaagtggatttgaacgt

SEQ ID NO: 50321 - DNA, 475 bp, Homo sapiens
  misc_feature 25, 46, 53, 90: n = A,T,C or G
agaattggaatatttaaggctggtngacattttttattttcatttnatatctnttgtatagctctacaaggcagtgttttgtaatttggnttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgtct

SEQ ID NO: 50322 - DNA, 121 bp, Homo sapiens
tgaggtataaacctttagatgtgaaaaatgtaatttcattctgctattgtgtgtgcttgtgtgtgtgtaattgaaaaaactgggaaatcctgctttgttggtaataaatcaatatttttat

SEQ ID NO: 50323 - DNA, 372 bp, Homo sapiens
  misc_feature 12, 22: n = A,T,C or G
tgctaagacttnaccagtcatnagcgaactactatactcaattgatccaataacttgaccaacggaacaagttaccctagggataacagcgcaatcctattctagagtccatatcaacaatagggtttacgacctcgatgttggatcaggacatcccaatggtgcagcgctattaaaggttcgtttgttcaacgattaaagtcctacgtgatctgagttcagaccggagtaatccaggtcggtttctatctacttcaaattcctccctgtacgaaaggacaagagaaataaggctacttcacaaagcgcttcccccgtaaatgatatcatctcaacttagtattatacccacacccacccaagacagggttt

SEQ ID NO: 50324 - DNA, 381 bp, Homo sapiens
  misc_feature 195: n = A,T,C or G
aacagttgagccgatctaaggatgctagatagtcactaggtcagtggaaaaaatcagtggttctcactgtggtcagtgggttgttggtgatttcataataattggggactattcccggcaatgagtggatgcagccagggagaatgatgtcctgcagcatgtgggttagtgccacacaacgaagaattattctgnacgctgtaccgactgtatgactgaattcttacagcaaaaagttaatggtcaataaatacatttttgtgaacatcttccctaccagaaaaaggaaaagagcactgaacttccctaaaattactcttctatatatatttttttcaagaattatctgcaacacacccctgtagaagaatgtcaagcaga

SEQ ID NO: 50325 - DNA, 270 bp, Homo sapiens
tccggaaaatggtgaagaaaattgaaatcagccagcacgccaagtacacttgctctttctgtggcaaaaccaagatgaagagacgagctgtggggatctggcactgtggttcctgcatgaagacagtggctggcgggtgcttggacgtacaataccacttccgctgtcacggtaaagtccgcatcagaagactgaaggagttgaaagaccagtagacgctcctctactctttgagacatcactggcctataataaatgggtaatttatgt

SEQ ID NO: 50326 - DNA, 405 bp, Homo sapiens
  misc_feature 155, 156: n = A,T,C or G
ttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagccgaanngggccttgtgacgcaaggaggcaaagttatttggggaaaatatgcccaggttaccaacaatcctgaaaatgatggatgtataaatgcagtcttactggtttgcagcaatttcatatataattattgaggactacacaccaattgaagaaactgccattactgtgatgtttctgaatactaccaaacagccatacatgtctgcaatgaagagatttattaaattgtaaacattaaagtgataaaaaaaaa

SEQ ID NO: 50327 - DNA, 411 bp, Homo sapiens
aaacgcggaaccatggccgctgtggttgctgtttgcggtgttctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgttctccatttactggatgcatttatggaaggcacattacagggctttgtgggaagaaacagaaagaaatcacaaaagcaattaagagagctcaaataatggggttatgccagttacatacaaggatcctgcatatctcaaggccctaaa

SEQ ID NO: 50328 - DNA, 383 bp, Homo sapiens
  misc_feature 47, 359: n = A,T,C or G
aaggctattcctccccagaacctgacattcaagactcctctggaagngaagctcaatcagtaaaaccaagtacaagaagaaagaaaggaatagaactgggagacattcagagttccatcgaatctataaaacaaacacaggaagaaattaaaagaaatgttatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggctgggaccagtgttcaagttggttggnctttataaaaaatcacaatattcc

SEQ ID NO: 50329 - DNA, 351 bp, Homo sapiens
ttataatgctagaaagtaaaaagagtggaatcatgtaaaattctcagttaaaccagaaaagacagaaaaagaagggaaggtaagaaaaacaaggacaagtgcacctgctagaaaacagcggcagacatggtagatattaatccaactatctcaataatcactttaaatgtgaatggcgctaaatataccaactaaaacacaaagactgccagtaggattaaaaaaaaaagacccaatgatatgttgtctgtaaaaaaacccattttaaatataaagacacaaatagcataaaaataaaggtataaagaaagatataccatgttaatactagtcaaaagaaaactggggtag

SEQ ID NO: 50330 - DNA, 464 bp, Homo sapiens
  misc_feature 28, 33, 36: n = A,T,C or G
cttcagacctctcaacgagtctgaagtnaaccncgncgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggttcatattttgaaatatatttggataagataagggcctgttagatgtttcaaagaccacctttcagtcatgaagacaaaaccgagttccctatgtaaggggtcacagagcg

SEQ ID NO: 50331 - DNA, 147 bp, Homo sapiens
gttagtttttcccccataacatttaattattactaaaattgtatttacaatagtggtgccaaatcaaatggtaatttaaataaaatctattctgtgtttatgtagggtggtataaaaaagaggtcttcatttagacatgtgatttct

SEQ ID NO: 50332 - DNA, 201 bp, Homo sapiens
  misc_feature 63, 81, 132: n = A,T,C or G
gcttaccttgtgacctagcagtctcttctaggcatatacccaagagaaatgagtgtttatatncaccaaaatactgtacangaatgctcatacataacaactttcttcatgatagaacaggaaacaacccanatgtccatcagcaggagaatgagtaaacaaatttgtagtatattcacatagtggagtactatttgacac

SEQ ID NO: 50333 - DNA, 420 bp, Homo sapiens
  misc_feature 47, 61: n = A,T,C or G
ccactgcgcagaccagacttcgctcgtactcgtgcgcctcggttcgnttttcctccgcaancatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcaggggaaggaaagaacttgcatgttgg

SEQ ID NO: 50334 - DNA, 444 bp, Homo sapiens
  misc_feature 130, 318, 391, 439: n = A,T,C or G
gctcgtgaagactccagcagccaagatggtgaagcagatctgagagcaagactgcttttcaggaagccttggacgctgcaggtgataaacttgtagtagttgacttctcagccacgtggtgtgggccttncaaaatgatcaagcctttctttcattccctctctgaaaagtattccaacgtgatattccttgaagtaagatgtggatgactgtcaggatgttgcttcagagtgtgaagtcaaatgcatgccaacattccagttttttaagaagggacaaaaggtgggtgaattttctggagccaataaggaaaagctngaagccaccattaatgaattagtctaatcatgttttctgaaaatataaccagccattgctatttaaaacttgnaatttttttaatttacaaaaatataaaatatgaagacataaacccagntgcca

SEQ ID NO: 50335 - DNA, 359 bp, Homo sapiens
  misc_feature 206, 312, 321, 324: n = A,T,C or G
agaaacaagtaacatacaacagaaatcaatacatttggcggcagatttatcaatggaaatctcacaggccaggggagaatggaatgacatgtttaaagtgctgaaggaaaagaactttaacttttgaagagtatatctggtgaaactattcctcaagcctgaaggagaaataaagaccctcgcagacaaacaaaagctgagtgatntcgtcaacaccagacctaccttataagaaatgctaaaggaagctcttcaatctaaaagaaaaggacattaatgagcactaagaaatcatctgaaagtacaaaactnagtggtagnagntaactggacagaaaaccacttaatattgtaaccgc

SEQ ID NO: 50336 - DNA, 201 bp, Homo sapiens
  misc_feature 58, 173: n = A,T,C or G
gagcctgctctccccttcctcctatatgacttttttggttcttaattgccttcacagngggatgggacaagaatcaaacatcctaattaaaagacagaaaaacagacccccgcaaaatcacatgacttggctacagatttcagataggttttaattgacctatcatattaacnacataccaataaactttaatttatgcat

SEQ ID NO: 50337 - DNA, 446 bp, Homo sapiens
  misc_feature 10, 53, 68: n = A,T,C or G
gccgattgcngacccacaacctttagactgaggacttttaccgttggtgcccntaaccttatcagganggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaagcagagaagtctcaaagttaattcacctatgtta

SEQ ID NO: 50338 - DNA, 480 bp, Homo sapiens
  misc_feature 423, 442: n = A,T,C or G
aataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccgggaccccttggttgatgcactgcagcatggtggctttctgagtcctgttgccaccaagtgtcagcctcagcactcccgggactattgccaagaaggggcaagggatgagtcaagaaggtgagacccttccggtggcacgtggccagctgtgtgagatgttggatgtttggtactgccatgtctgggtgtgtgcctattacctcagcattctacaaaggnaccatgtaacatggtttgngtatataaaagggagggtttttttaaaaatatattcca

SEQ ID NO: 50339 - DNA, 449 bp, Homo sapiens
tccttcttgccatcctggccgcttagcggaagcaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggcaaatgagactgagggaagaaaaaaaatctctttttttctggaggctggcacctgattttgtatccccctgtagcagcattactgaaatacataggcttatatacaatgctctttcctgtatattctctggctggctgcacccctttttcccgccccca

SEQ ID NO: 50340 - DNA, 355 bp, Homo sapiens
  misc_feature 15: n = A,T,C or G
ttttaaatgaagagnttctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataatta

SEQ ID NO: 50341 - DNA, 122 bp, Homo sapiens
  misc_feature 18, 50: n = A,T,C or G
gcaggccacttatctaantaggggtcattatctaaaatatataaggaacnccttcaactcaatagcaaaaagcacataaccttattaaaaagttgaaacctttgcagagcagtagtaaatcg

SEQ ID NO: 50342 - DNA, 153 bp, Homo sapiens
  misc_feature 140: n = A,T,C or G
taaaacatgacggaggttgagatgaagcttcttcatggagtaaaaaatgtatttaaaagaaaattgagagaaaggactacagagccccgaattaataccaatagaagggcaatgcttttagattaaaatgaaggtgactnaaacagcttaaag

SEQ ID NO: 50343 - DNA, 486 bp, Homo sapiens
  misc_feature 16, 252, 356: n = A,T,C or G
gggacttcccagacgngatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggccgcaggggtaatgaagatatcatgatcacagtgattcccgaagaaattgacccataggcagaggcatgagctgnacttcatgtttccctcaaagactctcccgtggatgacggatgaggactctgggctgctggaataggacactcaagacttttgactgccattttggttgttcagntggagactccctggcaacagaatccttcttgataggttgcaggcaaaacaaatgtaatgttgcagatccgcaggcagaagctctgccttctgtatcccatgtatgcagtgtgcttttcttgccagcttgg

SEQ ID NO: 50344 - DNA, 127 bp, Homo sapiens
  misc_feature 86: n = A,T,C or G
gagcatattctctagtatatagctacacctttaataaaatgaaggaatgtcttcaatcatattttagtgggctatttataaatagncttgaagtcaatttagtttatttatttaaaagataatgcac

SEQ ID NO: 50345 - DNA, 308 bp, Homo sapiens
tctatttagcagggaaagtataagcaatttatctttaatggaagggatggttgggaggccataatctcctcttctactacttgataagatatgattaaaggaaagcaagttaaggataataattatttaaacataatcctttatgtcaaaattaatattgcatgaattttgaattctatatttacctgaaagaaacctgtaaaatctcggtgctgtgtggcgttacagattttagtgcattgaggtgtgagacagtgagtacagatagagggagacaagatagagaatccttgctcccatcagtattt

SEQ ID NO: 50346 - DNA, 293 bp, Homo sapiens
tggcaaatcctgcaaccagggcccttaccctcttgtccaagcagtcaagagaagccttggctccctgtgaaggattaacttacagagaagcaggcaagatgaccttgctgcctggggctgctctctcccaggaattctcatgtgggattccccttgccaggatggcctttggatctctcttccaagcctttcctgacttcctcttagatcatagattggacctggttttgttttcctgcagctgttgacttgttgccctgaagtacaataaaaaaaattcattttgctccagt

SEQ ID NO: 50347 - DNA, 526 bp, Homo sapiens
  misc_feature 489: n = A,T,C or G
gagtgcttcatgcctttagatgtacaggctgacagagaagattcccgagagaaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtagggaaagtcacccaaacacttctgctttcacttaagtgtctggcccgcaatactgtaggaacaagcatgacttggtactgngatatttaaaatatccacagtactcactttttccaaa

SEQ ID NO: 50348 - DNA, 467 bp, Homo sapiens
  misc_feature 32, 42, 53, 54, 67, 78, 84: n = A,T,C or G
agagacagggaaaattatgacagaggttactntagcctgctnaaaagagattnnggggcaaaaactnagaatggagtntacagngctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgtatctgacaagatagttatttaagaaacatgggaattgcagaaatgactgcagggcagcagtaattatgggcactttttcgctatttaag

SEQ ID NO: 50349 - DNA, 355 bp, Homo sapiens
  misc_feature 312: n = A,T,C or G
ccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggctgccaatctgtacaaaatggcctatttttgtgaagagggacataagataaaatgatgttatacatcaatatgtatatatggaatntctatatagacttggagaatactgccaaaacattatgacaagc

SEQ ID NO: 50350 - DNA, 487 bp, Homo sapiens
  misc_feature 46, 47: n = A,T,C or G
ataaaactcatgggtagaacatatacacaaatgagaaaaaatccanntgttatcactacaaaaaacctcacctattaataacaaccttgaatataaatggtttaaatccattaattaaaatacatcctgattgaatggattttgaaaaaatttaatatccaactatttcctgtctacaagaaactcccttcacctgtaaagacacacatagattgaaagtgaagggatggaaaaatattccatataaattgaaaccaaaagcatgcagaagtagctatatttatgttagaggaaacagactttctttatatttatgttagagagaaacaaacaaagaaggccattatataataataaagagatcgattcagaaaaagaatataaaaactgtaaatatatattcacctaggaaggggagcagcccgatatataaagcaaatattattagggctaaaaagaggagctagactccagtacagtaataggt

SEQ ID NO: 50351 - DNA, 401 bp, Homo sapiens
  misc_feature 50: n = A,T,C or G
gaggcattgaggcagccagcgcaggggcttctgctgagggggcaggctgnagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaggaaaattgagagaaaggactacagagccccgaattaataccaatagaagggcaatgcttttagattaaaatgaaggtgacttaaacagcttaaag

SEQ ID NO: 50352 - DNA, 336 bp, Homo sapiens
caggccaagaagcatcctgagcttgatccccctctttgtatttattggaactggagctactggagcaacactgtatctcttgcgtctggcattggtcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggcttccagaagccacatccgcacaattttccacttaaccaggaaatatttctcctctaaatgcatgaaatcat

SEQ ID NO: 50353 - DNA, 231 bp, Homo sapiens
  misc_feature 167: n = A,T,C or G
atcttgtgccttgctcttggtttttattacctggagctccatcatgagtctcagggtggattgaaatcttgcattgaggccaaaagtgaaaggaaaaccaggacaaagaaatctgcagggcaaggggtggggcttggtagcaagagcaatggaaaacaacgacaatnaagtagcttgtagcttgctgctaatgtgtgtaaagcgatggtacaggcaagatggagttaatcc

SEQ ID NO: 50354 - DNA, 209 bp, Homo sapiens
  misc_feature 39, 48, 91, 94: n = A,T,C or G
acatgccctggaggcctcatggtctcagtgctgaggcgncacacctgnagcacacctgcgtaatgtgcggtctgggccagtcacaaggaantgngttgtctaagccaaagggggaagctgactgtgatttaccaaaaaaaattctgtaattcaaaccaaaatgtctgcggaatcaccagtttgatactctctgtaatcagaacagtggg

SEQ ID NO: 50355 - DNA, 191 bp, Homo sapiens
aactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaag

SEQ ID NO: 50356 - DNA, 402 bp, Homo sapiens
  misc_feature 46, 345, 372: n = A,T,C or G
tctaggtcaactggcctcatactgatttgccatgagctcacaaaangaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgcttctgctattttatctacttttgaacactttcaggactttttagccagtttgcctttcttgaaaaatgttatgttttcagcaataaatacatttgataatgactttgttgnatcattttatgttcacaaagaagagtngcttgatgaatgagatacctgaaaaataaa

SEQ ID NO: 50357 - DNA, 356 bp, Homo sapiens
gctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccataaacattt

SEQ ID NO: 50358 - DNA, 183 bp, Homo sapiens
  misc_feature 107, 127, 148: n = A,T,C or G
gagtcttctgtaattcattgagcagttagctcatttgagataaagtcaaatgccaaacactagctctgtattaatccccatcattactggtaaagcctcatttgaangtgtgaattcaatacaggcnatgtaaaatttttactaatgncattattttgaaaaaataaatttaaaagtacattc

SEQ ID NO: 50359 - DNA, 136 bp, Homo sapiens
tgcaacttcaagacaaaataaaaagtaaacatttacatgaaaaatggtggatatggaaggtggagaagagaggagataacagctttatctttcaaaatagagaattgagagatggtaccaaaagctgatgaagtac

SEQ ID NO: 50360 - DNA, 424 bp, Homo sapiens
  misc_feature 23, 39: n = A,T,C or G
tagggcctggtggctatggtcgnttctctcctttccagncggagacctctgccgcaaacatgctccgcagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggcccaatgatcaatacaagttctactcagtgaatgtggattacagcaagctgaagaaggaacgccagatttctaaatgaaatgtttcactataacgctgctttagaatgaaggcttccagaagccacatccgcacaattttccacttaaccaggaaatatttctcctctaaatgcatgaaatcatgttggagatctc

SEQ ID NO: 50361 - DNA, 120 bp, Homo sapiens
  misc_feature 10, 81, 100: n = A,T,C or G
gaacaaaaantgccacactcagtgcagcaatatattaccagcaagaataaaaaagaaatccatatcttaaagaaacagctntcaagtgcctttctgcagnttttcaggagcgcaagatag

SEQ ID NO: 50362 - DNA, 376 bp, Homo sapiens
aacaaacactaatgttaattgcccaattgagttgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttgggttgggatcaataagg

SEQ ID NO: 50363 - DNA, 480 bp, Homo sapiens
  misc_feature 59, 60, 75, 303, 415, 450, 458: n = A,T,C or G
aaaaagatctagaaactgagtgtgtggagctgactctaatcaaatgtgatgattggaannagaccatttggcctntgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaactccttaaaaataaagatggntaatcactaccattgtgaaaacataactgttagacttcccgtttctgaaagaaagagcatcgtccaatgcttgttcactgttcctctgcatactgtatctggaatgctttgnaatacttgcatgcttcttagaccagacatgtaggnccccttgngtctcgatcttttttttcttaa

SEQ ID NO: 50364 - DNA, 204 bp, Homo sapiens
  misc_feature 22, 128: n = A,T,C or G
tttcaatcttcgacagctggcnggaacgtgaactcagtagctgaacctgtctgacctggcacgttcttggatcctcagaactctttgctcttgtcggggtgggggtgggaactcacgtggggagcggngctgagaaaatgtaaggattctggaatacatattccatgggactttccttccctctcctgcttcctcttttcctgc

SEQ ID NO: 50365 - DNA, 116 bp, Homo sapiens
  misc_feature 73: n = A,T,C or G
catcaaagcagtggacaagaaggctgctggagctggcaaggtcaccaagtctgcccagaaagcgcagaaggcnaaatgaatattatccctaatacctgccaccccactcttaatca

SEQ ID NO: 50366 - DNA, 412 bp, Homo sapiens
acatcctaaagatgagacttctttaggaacatcctaaagatgagacttctttaggaacatcctaaagatgagacttctttaggaacatcctaaagaagttcctccagcatttaaaattgctaaacgtaggccagggtagagttaaaggctgaaagaaccttaattaatatgtattattccagttattagaagaaaagtcctatggattgaaattgctgcttgctggcaattacttttaattgctgtgcagggcattattaacgttgcaacgtctagcatagtgatgaaaattgatgttccagatgctttcatgtgagttctccttttcttttaatgtctcaagagcatagaatcatggggatgataagtgagattttgctagactctatacctgcttccatagaaatcccag

SEQ ID NO: 50367 - DNA, 217 bp, Homo sapiens
gaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactg

SEQ ID NO: 50368 - DNA, 463 bp, Homo sapiens
  misc_feature 417, 427: n = A,T,C or G
cccttcacatcgaagattttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagcttgtgttatttcataaataacttgggagaaactgcatcctaagtggaagaactagtttgttttagttttcccagataaaaccaacatgctttttaaggaaggaagaatgaaattaaaaggagactttcttaagcccatatagatagggttatgtataaaagcatatgtgctactcatctttgctcactatgcagcttttttaagagagcagagagnatcagatgtncaattatggaaataagaacattacttggcatgacac

SEQ ID NO: 50369 - DNA, 414 bp, Homo sapiens
  misc_feature 383: n = A,T,C or G
gtggaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagacattttatcatcatctgctttattcacataaatgaagttgtgatgaataaatctgcttttatgcagacacaaggaattaagtggcttcgtcattgccttctacctcaaagataatttattccaaaagctaagataaatggaagctcttgaccttgngaactgatgtgaaatgcagaatctcttttgg

SEQ ID NO: 50370 - DNA, 366 bp, Homo sapiens
  misc_feature 181: n = A,T,C or G
attatacatcttagatttatacatttcatatatgcttttaaagcttcaattaacagttcaatacaaaatttaaaaacaaatatatgcagcagtggttctcaggcacagaactgaggaggagactggagcaagtcttttccctagcatacatacagtgaatactatgaaccatgagagtggnatgtttccttctgacctagctgcctttttgattgaattttgttacaatgaacagctttaataggtatgatattgctaactggaaacaatgagatttaaaataaattgataacctgtattttcttgaagtctttaagacctaaaatgattacttttctcctaatagagctccagaatcatccaatg

SEQ ID NO: 50371 - DNA, 353 bp, Homo sapiens
  misc_feature 329: n = A,T,C or G
aaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgctttttaatgtaaatacccgtaggtatcattaatagttcaaaatattgtggttaagtaaagttgaacctggntataaatattatgcctttattttg

SEQ ID NO: 50372 - DNA, 197 bp, Homo sapiens
  misc_feature 59, 85, 118: n = A,T,C or G
tcaatccttcttctgcaaggaacacaatataacaacattacaatgcatctttgttttgnttttgctgatttgggtacgaacatancaaaaataaaaatgcgttcattttctgcatttngggaataaatctgaagccatgcttaacagaatagttttaagtttaaaatgaaataattttataaatattttaccctttt

SEQ ID NO: 50373 - DNA, 220 bp, Homo sapiens
  misc_feature 60, 122, 124, 140: n = A,T,C or G
tttcacaggcctggccacgctctcacggaaccactggcatcagatggtgaagtgactgcnacccggttgccatctgttgaacagacttttggatgaagtgtgttggggaagaggataaggtnanatctaggacaactctntgagttggccttcatataagaatcgggacggtaagagaataaacacttgtactgggatcagaatacatgatggatgaaat

SEQ ID NO: 50374 - DNA, 259 bp, Homo sapiens
  misc_feature 42, 65, 79, 81: n = A,T,C or G
gatttatgctttttacgtgaagctgctaaacttaaagtaaanggaagaaaccaagactagtaggntttttctttttttngngggggtgggatgggggaggttagttatacttaaaatatcttctccagagactgtatgctcctatactagactgtaagctctttgagggcagtccgtcaaatttatctttgtatcttccccagcgcctagtgtagtgccttgcacataataggcgcccaataaatattgatgaagaatg

SEQ ID NO: 50375 - DNA, 414 bp, Homo sapiens
  misc_feature 15, 78: n = A,T,C or G
tgcaagatcctgggnccattatcctactccaagatcaagcatttgcgtttggatggcaatcgcatctcagaaaccagncttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgtttgtaaacatttattttttttaaagaaaagatgaaaggcagcctatttcatcacaagaacacacacatatacacgaatagacatcaaactcaatgctttatttgtaaattagtggttttttatttctactgcaaatgatgtgcaaacctttactggtgcatg

SEQ ID NO: 50376 - DNA, 139 bp, Homo sapiens
  misc_feature 57, 85: n = A,T,C or G
atgtcaatatttagtaaagcttttcttttttaatttccaggaaaaaataaaaagagnatgagtcttctgtaattcattgagcagngtagctcatttgagataaagtcaaatgccaaacactagctctgtattaatcccc

SEQ ID NO: 50377 - DNA, 505 bp, Homo sapiens
gtttcaaccaatgaataaggcaaattatatataagttaataatgccatttcgaaccgagacagatggcagctaaatgaagtttaattaaagaatgagcgctggggccctttttattgggtactgcatctacttcgaccacaaaagacgaagtgaccccaacttcaagaacaggctttgagatggaagaaagaaacagaagcttgccaaggagagagctggctttccaagttacctgaccttaaagatgctgaagctgttcagaagttcttccttgaagaaatacagcttggtgaagagttactagctcaaggtgaatatgagaagggcgtagaccatctgacaaacggaattgctgtgtgtggacagccacagcagttactgcaggccttacagcaaactcttccaccactagtgtccagatgcttttgactaagctcccaacaattagagaatctaagtgctcagagcttggcttgaagatgatgtggatgagaaacaaatgtt

SEQ ID NO: 50378 - DNA, 311 bp, Homo sapiens
ctccggtttgccaatcctcttaagtattcctgtcttcaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtc

SEQ ID NO: 50379 - DNA, 266 bp, Homo sapiens
  misc_feature 39, 40, 69: n = A,T,C or G
aaaatgaataaagtacattcattgtgtatggaaaaatgnnccatgatacattaggtgaaacaagttatnaatagaaaagtgtacagtgtgaactcattttaaaatgtgtgggcttatgtttataaatgcatagaaaggtctattcacagctttctttgaacagtgtagatcacatgaaactttcaactttatacatttctgtattaatattttacactacccacattatttttaaactttattttaaataaagaatttttaaaatt

SEQ ID NO: 50380 - DNA, 358 bp, Homo sapiens
cagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggattttcacaaaaggctacttatagtgtagcattattgccttaaatcagaaagccctgggaagaggataaaagatatagaaatgagaaggctctgaagttataggcatttcttgctgtttaataggtacattatcacaaaaacaagccctattcatgattgaggactatggaaata

SEQ ID NO: 50381 - DNA, 390 bp, Homo sapiens
  misc_feature 5: n = A,T,C or G
ggggncaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttaagttcccaacatcgaatgtgtacaacttaagttggtcctttacactcaggctttcactatttcctttaaaatgaggatgattattttcaaggccctcagcatatttgtatagttgcttgctgatataaatgcaatattaatgcctttaaagtatgaatctatgccaaagatcactt

SEQ ID NO: 50382 - DNA, 486 bp, Homo sapiens
  misc_feature 12, 34, 46, 47: n = A,T,C or G
gttttagcggtncaagatctaccccggacacggnaggcgctacgcnnggaccgacgggaaggttttccagtttcttaatgcgaaatgcgagtcgctttcctttccaagaggaatcctcggcggataaactggactgtcccctacagaaggaagcacaaaaagggacagtcggaagaaattcaaaagaaaagaacccgccgagcagtcaaattccagagggccattactggtgcatctcttgctgatataatggccaagaggaatcaagaaacctgaagttagaaagctcaacgagaacaagctatcagggctgctaaggaagcaaaaaaaggctaagcaagcatctaaaaagactgcaatggctgctgctaaggcacctacaaaggcagcacctaagcaaaagattgtgaagcctgtgaaagtttcagctccccgagttgggggaaaacgctaaactggcagattagattttaaataaaggattgg

SEQ ID NO: 50383 - DNA, 235 bp, Homo sapiens
gggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatcc

SEQ ID NO: 50384 - DNA, 341 bp, Homo sapiens
  misc_feature 125, 339: n = A,T,C or G
cttttggcctcctgcaaagtctccagaagaaaatttgccaatctttcctactttctatttttatgatgacaatcaaagccggcctgagaaacactatttgtgactttttaaacgattagtgatgnccttaaaatgtggtctgccaatctgtacaaaatggtcctatttttgtgaagagggacataagataaaatgatgttatacatcaatatgtatatatgtatttctatatagacttggagaatactgccaaaacatttacgacaagctgtatcactgccttcgtttatatttttttaactgtgataatccccacaggcacattaactgttgactttnga

SEQ ID NO: 50385 - DNA, 365 bp, Homo sapiens
ctttctgggctcggacctaggtcgcggcgacatggccaaacgtaccaagaaagtcgggatcgtcggtaaatacgggacccgctatggggcctccctccggaaaatggtgaagaaaattgaaatcagccagcacggccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgcatcagaagactgaaggagttgaaagaccagtagacgctcctctactctttgagacatcactggcctataataaatgggttaatttatg

SEQ ID NO: 50386 - DNA, 118 bp, Homo sapiens
gagattaatacaactacttaaaaaatatagcaatagggtactaagatattgcttagcgttaagtttttaacgtaattttaatagcttaagattttaagagaaaatatgaagcttagaa

SEQ ID NO: 50387 - DNA, 131 bp, Homo sapiens
  misc_feature 25, 33, 43, 48, 87, 88: n = A,T,C or G
aaaattttagtacttaaaggttttnaattatcncgaaggccangcatngcatttgtaaacagtcctggtcagtagttaaataatgtnncaattaaagtgctgtaaaataaacttcaaagtggttataagtt

SEQ ID NO: 50388 - DNA, 161 bp, Homo sapiens
  misc_feature 28: n = A,T,C or G
agacaagcaacccaaactgaaccccctnaaaagccaaaaaatgggagacaatttcacatggactttggaaaatatttttttcctttgcattcatctctcaaacttagtttttatctttgaccaaccgaacatgaccaaaaaccaaaagtgcattcaacctt

SEQ ID NO: 50389 - DNA, 108 bp, Homo sapiens
  misc_feature 19: n = A,T,C or G
gatggtgctagaagaattngagaagaaatactcctgtattgagttgtatccgtgtggcgtattttttaaaaaatttgatttagcattcatattttccatcttattccc

SEQ ID NO: 50390 - DNA, 148 bp, Homo sapiens
cctcttcctgctgctctgggttgacatctacgtgtgagcacccaagggtaacaaccagatggctcactgaaacctgcttttgtaaattacttttttttactgttgctggaagtgtcccacctgctgctcataataaatgcagatgtat

SEQ ID NO: 50391 - DNA, 267 bp, Homo sapiens
  misc_feature 36, 142, 222: n = A,T,C or G
ctactctctctttctggcctggaggctatccagcgnactccaaagattcaggtttactcacgtcatccagcagagaatggaaagtcaaatttcctgaattgctatgtgtctgggtttcatccatccgacattgaagttgacntactgaagaatggagagagaattgaaaaagtggagcattcagacttgtctttcagcaaggactggctttctatctcttgnactacactgaattcacccccactgaaaaagatgagtatgcctgcc

SEQ ID NO: 50392 - DNA, 355 bp, Homo sapiens
gaccatctgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattaagtgctgcagaacttcgcatgtgatgcaaaccttggagagaagttaacagatgaaga

SEQ ID NO: 50393 - DNA, 399 bp, Homo sapiens
aaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgccccaggagccgtactctgacagctgtgcacgatgccatccttgaggacttggcttcccaagcgaaattgtgggcaagagaatccgcgtcaaactagatggcagccggctcataaaggttcatttggcaaagcacagcagacaatgtggaacacaaggttgaaactttttctggggctataagaagctcacgggcaaggatgttaattttgaattcccagagt

SEQ ID NO: 50394 - DNA, 379 bp, Homo sapiens
  misc_feature 43: n = A,T,C or G
ggatgaggagaatgaggattttacgccggctgctcagaagatnccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtcatactgcctctgtgattacatagatcaagccattaaaataaaacaagcctt

SEQ ID NO: 50395 - DNA, 428 bp, Homo sapiens
  misc_feature 72, 306: n = A,T,C or G
tctaacaactgaagaagatcaaagttcatattcttttgccaaagacctaaaacgttaatcacctacatactntggaaagagaaaattatactattattttcatctaatggaaagtttgaagatttcttcaaagtgcaggaaaaaactttaactgggcatggtggctcatgcccattatcccagcactttgggaggccaaggagggaggattgtttgaggccaggaagacctgcgtaatgcagtgagaccctgtctctacaaaaaaaaatccccaaaattgggtgtgttggcatgtatacctgtagncccagctactcgggagactgaggtgggaggatcacctgagcccaggaagtcgagactgcagtgaactatgattgtgccagtacactccaacctggaggacaggttgagggctgtttcaaaaa

SEQ ID NO: 50396 - DNA, 464 bp, Homo sapiens
  misc_feature 24: n = A,T,C or G
gccgcagctagaaatgctcaaganccagctggaccaggaagtggagctcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccgaccagctcttcaggagaagcacgccatgaaacaggccgcatggaaatgatgagtcagaagattcagcagctcacagccctgggggcagctcaagctactgctaaggcctgagagtttttgcagaaatggggcagagggacaccctt

SEQ ID NO: 50397 - DNA, 247 bp, Homo sapiens
  misc_feature 48: n = A,T,C or G
ggatgagctgggacttagcctaacagatgagctgtcgaacctcccctnaactgggggctcgcttagtgtgctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacg

SEQ ID NO: 50398 - DNA, 494 bp, Homo sapiens
gtaggaagaaaactagaagatagaaaaaaagcaagatagaaagacaaaaggaagaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctgggggtgcagaagttagaaggtaaagcttgagaagatgagggtgtttacgtagccaga

SEQ ID NO: 50399 - DNA, 467 bp, Homo sapiens
aatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagtctaacacattagtagaaatggactcttggatgaagaaattaaaggaagagatggaaggggtggtaaagaac

SEQ ID NO: 50400 - DNA, 356 bp, Homo sapiens
actcatgataaactgacatggctaaccgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgcagatgtttttcagttatctccccattg

SEQ ID NO: 50401 - DNA, 385 bp, Homo sapiens
  misc_feature 10, 77: n = A,T,C or G
tagccaaacnatttacccaaataaagtataggcgatagaaattgaaacctggcgcaatagatatagtaccgcaaggnaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtcc

SEQ ID NO: 50402 - DNA, 284 bp, Homo sapiens
  misc_feature 15, 72: n = A,T,C or G
gtaaggtgctccggnataacatccagggcattacaaaaccggctattcgccgtttggctcggcgccggtgcngcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggctcctgagaacttc

SEQ ID NO: 50403 - DNA, 448 bp, Homo sapiens
  misc_feature 6, 55, 59, 77: n = A,T,C or G
aagttntccagcttcagctcaactcacagcttctccaagcatcaccctgggagtntccngaggggtttctcataaangagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgtactgtgatattttaaatatccacagtactcactttttccaaatgatcctagtaattgcctaggaaatatctttctcttacctgtatttatcaatttttcccagtattttatacggaaaaaattgtattggaaaacactag

SEQ ID NO: 50404 - DNA, 384 bp, Homo sapiens
  misc_feature 41, 66: n = A,T,C or G
taatatttttttaaagttacattaagattttttctcttttncagctacatttgaaagtgatagaanaaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatgggggcaaaatattagctctgttttgggacattttaaaatagaactatccttgtcgatagcataggaaaatgttctggtgattgtcaggggctcctaatatttatctcaattcttttat

SEQ ID NO: 50405 - DNA, 388 bp, Homo sapiens
  misc_feature 25, 31: n = A,T,C or G
agaaggaagagataaagacactttntcaaanatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacagggtcaccttgaggaggttgttttagctctgctaaaaactccagcgcaatttga

SEQ ID NO: 50406 - DNA, 452 bp, Homo sapiens
  misc_feature 39, 53, 56, 274, 292: n = A,T,C or G
tagtgtgacctgaacttggcctagttgcttggctctganacttaagagtactnggntgtactgtatttggttgtcaaggtaagttactagattaggactttgagacagtgtatttattgggaagcacgatgcttgtttaggtggctagacttcttatatttgtttttaggctaactgattttggaagaatctttctaaaatgtaaccctggtcatgtaagcaccttgcttaaaagtattccttagtgccaggaggtgttactttctcttcttgnaaaatattctttactgtntttttctcaatctgcctttctagctataattcacctcattcaagactcatcatgaagaactacttgaagttttccaaacatgctatcatatggcttctggacaaattccttgcttacttgctagactgctcttatcttcagtattgagcctgaacatgac

SEQ ID NO: 50407 - DNA, 252 bp, Homo sapiens
  misc_feature 183: n = A,T,C or G
taaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggntttaaatcacaagaatatgtattctttaataaagataatttatgatcatggtataattaattgaaattt

SEQ ID NO: 50408 - DNA, 105 bp, Homo sapiens
  misc_feature 6, 8, 9, 12: n = A,T,C or G
gaaagnanntanaaaactagttgaggacagctgtatttttttgttgaactatttagtagaattgtgcctttttgtctgtatgtgaataaatgctgtacattttgc

SEQ ID NO: 50409 - DNA, 452 bp, Homo sapiens
  misc_feature 44, 45, 410: n = A,T,C or G
gaggcagccagcgcaggggcttctgcttgagggggcaggccggnncttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggggacttaaacagcttaaagttagtttaaaaggtgnaggtgattaaaataattgaggcgacttttaaaaagagattaa

SEQ ID NO: 50410 - DNA, 153 bp, Homo sapiens
  misc_feature 31, 35: n = A,T,C or G
ccccattgaagccactcattgtgtgtgcgcngggngagaagaccagctccgtgtggtcctgtgcttgtactgccctgctttgcagttcctttgcacttactcatcgagtgctgttttgaaatgctgacattatataaacgtaaaagaaaatgt

SEQ ID NO: 50411 - DNA, 113 bp, Homo sapiens
  misc_feature 32, 34: n = A,T,C or G
acttgaccttatggatgatgctgcggagtgcntngtaagtgtttcatgatattccttaagaagtcaggatagtagttttcattccttagatggtacaagtgttgagacaaatg

SEQ ID NO: 50412 - DNA, 244 bp, Homo sapiens
  misc_feature 38, 43, 66, 131, 158: n = A,T,C or G
atttattaatgcgaacagtacctaacaaacccacaggncctanactaccaaacctgcattaaaaanttcggttggggcgacctcggagcagaacccaacctccgagcagtacatgctaagacttcaccagncaaagcgaactactatactcaattganccaataacttgaccaacggaacaagttaccctagggataacagcgcaatcctattctagagtccatatcaacaatagggaggacac

SEQ ID NO: 50413 - DNA, 250 bp, Homo sapiens
  misc_feature 28: n = A,T,C or G
aggaatgtttgtgtgtttaagcaaggantttggtctgacatagaaatatgaatatatctgtgctcacaggtgagtagcatctgtattctgactattccaaatgagtaatttttgtacctgcaatttgttacaaaagtgagttttccaaattattttcttaaatctgacaggttaaatagtttaaataaaattgtgtgtctaataggcatgattgagatctaaagagattttaccctgtatttaccagctt

SEQ ID NO: 50414 - DNA, 332 bp, Homo sapiens
tcttggagatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaac

SEQ ID NO: 50415 - DNA, 295 bp, Homo sapiens
gaaacaaaaatagttccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaaca

SEQ ID NO: 50416 - DNA, 390 bp, Homo sapiens
caagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctgccttcctgtctagtctctcctgtaagccaaagaaatgaacattccaaggagttggaagtgaagtctatgatgtgaaacactttgcctcctgtgtactgtgcataaacagatgaataaactgaatttgtactc

SEQ ID NO: 50417 - DNA, 344 bp, Homo sapiens
  misc_feature 22, 320: n = A,T,C or G
gaggacaagtggcctggccagnccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaggtatcatcaagggtttaatattgggaaaatttcttttngccacattatctctgtttattcac

SEQ ID NO: 50418 - DNA, 233 bp, Homo sapiens
  misc_feature 21, 57: n = A,T,C or G
ctataagaaaggtgatattgnagacatcaagggaatggggactgttcaaaaaggaangccccacaagtgttaccatggcaaaactggaagagtctacaatgttacccagcatgctgttggcattgttgtaaacaaacaagttaagggcaagattcttgacaagagaattaatgtgcgtattgagcacattaagcactctaagagccgagatagcttcctgaaacgtgtgaagg

SEQ ID NO: 50419 - DNA, 401 bp, Homo sapiens
  misc_feature 17, 38, 47: n = A,T,C or G
actgctgctagcagtcnactacagctagtagcagtagntggagatantttatcttatttgatatatttgatgaattacataaagtaatacacttccaaatactaaaccttattttttacaataagccctacttaaacatgtattattaatatattgctaaattctatatgctcttttatttagaatttttagatttttaaaatttgcttgctttatcagcaaatatttgaggatttcctgtatatcagggactcagggggaagagtggtgaacaaaatagataacccgggtttcatagaatttctgatcttgagggtggaaacatactttatacatgattatcaatgataaggtaaataattgctaatatgaaaagtatagcaaaaaagtagtgctgtaga

SEQ ID NO: 50420 - DNA, 452 bp, Homo sapiens
  misc_feature 395: n = A,T,C or G
atgcatgcatcagcaatccttgccacaagggggcacttgtgtgacaccaaccccctaaatgggcaatatatttgcacctgcccacaaggctacaaaggggctgactgcacagaagatgtggatgaatgtgccatgggtgagtaagcaggaactttttctgttctgtgaagtgctgttgagctcagcaaatgtttaaactgaagcacattttactgtagaagcaaattacatacacccaaacctcagattactcttgctacatggcagtgtttacaagtgacctttcagcatagccataaccatatattccattctggggattaactgtatgaaacgtatgactttgattcttaatataaagccctacctcaatgacagtttgggcagaaactgcnatagcagaaatgcataacagttgaggatctccgcttttatttctttttaaaataagg

SEQ ID NO: 50421 - DNA, 287 bp, Homo sapiens
  misc_feature 222: n = A,T,C or G
agtcttatggtgattgcacatttgagtatcttgattgaggtggtagtcaggcacatctacacatgggataaaattctatagagctacatatacacacacataaatgagtgtgtgtatcactggtgaaatctgaacatgctctatggatggtatcaatgtcaatttcctagttttgatattatattatagttgtgtaagatgttaacattaggggacgctggnagaaaagtgcacagaatttccctgtatattcctttgcagcatcctatgaatctataattcaaact

SEQ ID NO: 50422 - DNA, 368 bp, Homo sapiens
  misc_feature 36: n = A,T,C or G
gtgtctctgaaaattgcagaaaagattgtgaaagangcataccaagaaaagacagccacagtttatcctgaaccgcaaaacaaagaagcatttgtccgctcccagatgtatagtactgattatgaccagattctacctgattgttattcttggcctgaagaggtgcagaagatcagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgaggt

SEQ ID NO: 50423 - DNA, 437 bp, Homo sapiens
gtctcgtctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacagcatgatcttggtactgtgatatttaaaatatccacagtactcacttttcc

SEQ ID NO: 50424 - DNA, 181 bp, Homo sapiens
  misc_feature 140, 146, 151, 157, 174: n = A,T,C or G
aataacatcattgttggtggctgaatacattttggaagagagtttttcatcttagagattggtgaacaagtgtgagggttgtgagaaactcacagaatacaaatttgcctgtatgttttgtgggttttttttttcccttncaagangtttnctattnctaaattaaagtaattncaaggtg

SEQ ID NO: 50425 - DNA, 208 bp, Homo sapiens
actgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggcagattctagtgctgagaagaaacacgtttggtttggagag

SEQ ID NO: 50426 - DNA, 146 bp, Homo sapiens
  misc_feature 7, 141: n = A,T,C or G
tggaagngccagcacctggcacctattcatatagaacaggctgtactcaagacaacttctagcatttactttaagacttatataatttatttctattttgtgtgtactatagtcttgtgcatatgtagttgaacacacagngaaat

SEQ ID NO: 50427 - DNA, 233 bp, Homo sapiens
caaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctat

SEQ ID NO: 50428 - DNA, 371 bp, Homo sapiens
  misc_feature 15: n = A,T,C or G
aaatgaatgaaaatngatctgaagagaatattaaaacattttcacttgaatcttcacaatctaccagtactaggggttcttatttcctaggtagatggaaagtgttttcgatgaatttggaccagaattggtacaaaaatcaaagaattcaaaatattaaattattttgtctctctttaagattgttataatttgattaagtactcttttttagtgtcatcagaaaaataaagcataggctgggcatggtggctgatgcctgtagtcccagcactttgggaggccaaagcgggaggattgcttgagctcaggagttcaagactagcctggcaacctagtctcttttatagagaccttgtctctataaaaat

SEQ ID NO: 50429 - DNA, 404 bp, Homo sapiens
  misc_feature 21: n = A,T,C or G
caataggaaagcatatgcagncaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggaataattatggtgggtgattattttttatactgtatgtgccaaagctttactactgtggaaagacaactgttttaataaaagatttacattcc

SEQ ID NO: 50430 - DNA, 431 bp, Homo sapiens
  misc_feature 6, 39: n = A,T,C or G
tttcgnccggaaccgccatcttccagtaattcgccaaantgacgaacacaaagggaaagaggagaggcacccggatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgcct

SEQ ID NO: 50431 - DNA, 481 bp, Homo sapiens
  misc_feature 4, 24, 311: n = A,T,C or G
acantgcctgttctgcttcgaagnattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttattnatcaatttttcccagtatttttatacggaaaaaattgtattgaaaacacttagtatgcagttgataagaggaatttggaataattatggtgggtgattattttttatactgtatgtgccaaagctttactactgtggaaagacaactgttttaataaaagattacattcc

SEQ ID NO: 50432 - DNA, 411 bp, Homo sapiens
atggcccttgacattgagattgccacctacaggaagctgctggaaggcggaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcagggagcgcaagatagatttgggaataggaataagctctagttcttaacaaccgacactcctacaagatttagaaaaaa

SEQ ID NO: 50433 - DNA, 416 bp, Homo sapiens
gaggacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttggatggcgcatcctcatgacatcatcgatgacatcaacagtggtgctgtggaatgcccagccagttaagccaaaggaaaacatttcaataaaggatcatttgcaaaaaaaaaaaaa

SEQ ID NO: 50434 - DNA, 230 bp, Homo sapiens
ccacaaaaccactgaacacttcaagattctctactttaaaggaaatacttctgacagagaacctgtcagccaggaggagctgtcatccagtgactcatgagtccttctggattcttgtttaaactcatcaaggtgacttcagaacagaaagtcttttctaaaagtgctgaccttgaaaacaaagagtacattgattgagggtgtttggtattccctcatgcctctgcagg

SEQ ID NO: 50435 - DNA, 367 bp, Homo sapiens
  misc_feature 20, 56: n = A,T,C or G
cctgccacaggatataactnttttttatataacaagcataacacaccactgctttnggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgctgtagggggaaataaagttaattcaaattct

SEQ ID NO: 50436 - DNA, 287 bp, Homo sapiens
  misc_feature 154: n = A,T,C or G
gaccaatgactttgtcatgctgaaaggctgtgtggtgggaaccaagaagcgggtgctcaccctccgcaagtccttgctggtgcagacgaagcggcggctctggagaagattgaccttaagttcattgacaccacctccaagtttggcatggcgnttccagaccatggaggagaagaaagcattcatgggaccactgaagaaagaccgaattgcaaaggaagaaggagcttaatgccaggaacagattttgcagttggtggggtctcaataaaagttattttccactg

SEQ ID NO: 50437 - DNA, 339 bp, Homo sapiens
gctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtgccactgaggtgttgatgtggttttatgtcggagagattataggcaagcgggcatcattggctatgatgtttgaagaccaatctttaacatctgattatatttgatttattatttgagtgttgttgaccatgtgtgatcagact

SEQ ID NO: 50438 - DNA, 233 bp, Homo sapiens
gacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcct

SEQ ID NO: 50439 - DNA, 325 bp, Homo sapiens
  misc_feature 41: n = A,T,C or G
ccccaacaccttccactaagccagctccccctcctgacctntcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttc

SEQ ID NO: 50440 - DNA, 212 bp, Homo sapiens
  misc_feature 149: n = A,T,C or G
attttaactcaaacaagagtaattatttttgagctcccatttcatgtgaggtgccacggtaggtatcagcatacagagacagagagacacacattttctgagatgctcacaagctgcttactgaaacatcttgtgaccagacatgacanagcgaggtgattgcaggccagaaaagggaaagagaggcaaaggaagaaagaagacatgaaacc

SEQ ID NO: 50441 - DNA, 185 bp, Homo sapiens
aaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctg

SEQ ID NO: 50442 - DNA, 309 bp, Homo sapiens
  misc_feature 35: n = A,T,C or G
atgataactactgacgaaagagtcatcgactcagntagtggttggatgtagtcacattagtttgcctctccccatctttgtctccctggcaaggagaatatgcgggacatgatgctaagagtcctgggtaaatgtggtgagaatgcacgcgtcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagctac

SEQ ID NO: 50443 - DNA, 133 bp, Homo sapiens
  misc_feature 68: n = A,T,C or G
cagaataaaaaataggataatttaacctaccagcccttctcccccaataactgtggtctatacagagncaatatattttttcagagaaagttattcgctcgattttttctgaatcataattaaactttatgat

SEQ ID NO: 50444 - DNA, 451 bp, Homo sapiens
tcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggctttactggatcccaaaagcatttaaggtacatgttccaaaaactttgaaaagctaaatgtttcccatgatcgctcattcttcttttatgattcatacgttattccttataaagtaagaactttggtttcctcctatcaaggcagctattttattaaattttcacttaagtctgagaaatagcagatagtctcatattaggaaaactttccaaataaaataaa

SEQ ID NO: 50445 - DNA, 252 bp, Homo sapiens
  misc_feature 72: n = A,T,C or G
aaaagaaacacttattcaaaagcccaagtcagcaggagaaaataggtgacgtgtgccacggaaaactcaaancccttggagaatcaacatttcattggttcagaagacaatgaccaaaaggataacatacaaaccggtgtggaaaatgttgtcctttgagtggcaagaattagaaaaatcttcaaaaatatagttggtggtttttttagttatgatttaagtttagtttcattttgtccatgtgacagtcat

SEQ ID NO: 50446 - DNA, 163 bp, Homo sapiens
gctatgaccttggagaacgcaaaccatccagtgctgcttatcagaaggcacctactaaggagttttatgccgtaaaactccaacttagtggctctatttatgagatcactgaacttttcaaaataaagcttttgcatagaataatgaagatctttggtttttg

SEQ ID NO: 50447 - DNA, 335 bp, Homo sapiens
  misc_feature 9, 55, 56, 59, 64: n = A,T,C or G
gcctgattngattatgaagctgcttaatcactcttcatgtgttcagaagtactgnnttntttgntatgttttccttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgcttgcatcaacagctgcttatttatgatatataagtagaaatagagcaaatgttggaatctgtatttttagtaccatgctttaataaagctaagtattttagagc

SEQ ID NO: 50448 - DNA, 111 bp, Homo sapiens
  misc_feature 42, 53, 57, 98: n = A,T,C or G
agaagctccttccagcacctactctcttctccttttgcccantctcacccagngagngtgagcatttaagaagcatcctctgccaagaccaaaagganagaagaaaaaggg

SEQ ID NO: 50449 - DNA, 531 bp, Homo sapiens
  misc_feature 432, 455: n = A,T,C or G
gttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgcagaatgaagtatacaagtcaatgtttttccccctttttatataataattatataacttatgcatttatacactacgagttgatctcggcagccaaagacacacgacaaaagagacaatcgatataatgtgggccttgnatttaactctgtatgcttaatgnttacaatatgaaggtataagtcttagaatgcagaatgtattgtaataaaataagcttggcctagcatggcaaaatc

SEQ ID NO: 50450 - DNA, 118 bp, Homo sapiens
  misc_feature 10, 36: n = A,T,C or G
ccagctactngggaggctgagacaggagaatcactngaacctgggaggcagaggttgcagtgagcctgagatcgcgccactgcactccagcctaggcaacaaagtaaaactccatctc

SEQ ID NO: 50451 - DNA, 281 bp, Homo sapiens
accaagatgcaaatgtcttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattggattggaaaacacttagtatgcaggtgataagag

SEQ ID NO: 50452 - DNA, 255 bp, Homo sapiens
caagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcg

SEQ ID NO: 50453 - DNA, 117 bp, Homo sapiens
  misc_feature 9, 19: n = A,T,C or G
ggcggagangagatacacngcacgtcacaaaccctggagggacctgtgaaactgaaacagatgttgctggtaacacaacagaggacaaaaacatggactccttaaagatagtcaacc

SEQ ID NO: 50454 - DNA, 190 bp, Homo sapiens
  misc_feature 38: n = A,T,C or G
acaagcatgttcctccttttcttcaccctccccttttntcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttc

SEQ ID NO: 50455 - DNA, 372 bp, Homo sapiens
agaattttaccttaattcacttaaagaaaattaaccattttttggtccaacttcagatattttcttaatccagaagctgtgactggtcccagaagaaacctcttatatcacatttaaaacataaaaaataattacactttcactcattctaatgggtaaattgttgaattgtaataaacaactgtatatttacaaacaggtttataaggtatttgctatcaaattaataataaaataaaacttacgggtctgcaaggaaaactatgaaggccacttaaagtggtcaggtatccctttgcttgtaggggcatagctgtgggttaagccagcttttacagaatttaattttaaagatcctataactatcaactt

SEQ ID NO: 50456 - DNA, 276 bp, Homo sapiens
gatatacacaaaagaaagagtttctaatatgaattcataaatactgacctcagtgtctcttctactcagtgcacagctattaagttttattaggtttcagttgtaactactttgtgtggatatatgttacgtttttcatatttatcctactcaatcaatctcagttttaccagaagaattacatttattagccataacagtggcccttctcttattcttttcagggctgatatcttttttactcatgagatttcaaaaagaactatcaccaccact

SEQ ID NO: 50457 - DNA, 333 bp, Homo sapiens
  misc_feature 57: n = A,T,C or G
gaaactcaataacattacttgtataatggtgctggccatgttgttgttttaatcagntgcctctttttaaaagaaatttttatggaaaacacattcaactatcattaaaaaaatggagttaagctgttggggccatttctttaagatttaacaaaagttcagccttttaggtagttgaagggaagtacaccccgtattcagcacatgttgagttttctacaccaggaattttcaatatgtatattgatgaaaacaagctcaattcaaactggacaggtttaagataatggtaaaatcagccttttagagacaacgaaggccaagaatcagtac

SEQ ID NO: 50458 - DNA, 145 bp, Homo sapiens
ggaaaaaattgtattgaaaacacttagtatgcaggtgataagaggaatttggtataattatggtgggtgattattttttatactgtatgtgccaaagctttactactgtggaaagacaactgttttaataaaagatttacattcc

SEQ ID NO: 50459 - DNA, 367 bp, Homo sapiens
cacgatgtttcccttggtcaaaagcgcactaaatcgtctccaagttcgaagcattcagcaaacaatggcaaggcaggagccaccagaaacgtacacctgattttcatgacaaatacggtaatgctgtattagctagtggagccactttctgtattgttacatggacatatgtagcaacacaagtcggaatagaatggaacctgtcccctgttgcagagttaccccaaaggaatggaggaatcagtaatcatcccagctggtgtaataatgaattgtttaaaaaacagctcataattgatgccaaattaaagcactgtgtacccattaagatatggcattattgaagaaataaagtcatttgaaaccc

SEQ ID NO: 50460 - DNA, 330 bp, Homo sapiens
  misc_feature 13, 268: n = A,T,C or G
cttccagcagcgntatgttgggccagagcatccggaggttcacaacctctgtggtccgtaggaccactatgaggagggccctgggaagaatttgccattttcagtggaaaacaagtggtctgttactagctaagatgtgtttgtactttggatctgcatttgctacacccttccttgtagtaagacaccaactgcttaaaacataaggatgtttcaagttcctccatttaacagatatgaagagcattttaagaggtgcagcctctgnaagtggatcaaactagaactcatatgccatactagatatgtttgtcaataaacttatgacgt

SEQ ID NO: 50461 - DNA, 301 bp, Homo sapiens
  misc_feature 68, 80, 276: n = A,T,C or G
aagtcaaatgaaacaaagagtcctcttcgtggaaaagaaaaaaatacgctccctttaaacggtggatngaaaatgacttngatttataaagagaagactgagggcggggatacttgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggnatttttatagcccttaataaaaaat

SEQ ID NO: 50462 - DNA, 435 bp, Homo sapiens
gccgaggaacaagtcggtcaggaagcccgcgcgcaacagccatggcttttaaggataccggaaaaacacccgtggagccggaggtggcaattcgccgaattcgaatcaccctaacaagccgcaacgtaaaatccttggaaaaggtgtgtgcttgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacaagtccttctgagattgttaagcagattacttccatcaagtattgagccaggagttgaggtggaagcaccattgcagatgcttaagtcaactattttaataaattgatgccagttgt

SEQ ID NO: 50463 - DNA, 278 bp, Homo sapiens
  misc_feature 157: n = A,T,C or G
cctggaaaggtctctgtattccagtggttctcaaactttttggtctcaacttcttcatgcttttaaaaattatttttggccaggtgtggtggctcacgcctgtaattgcagcaccttgggagggtgaggaggagaaccacttgaggtcaggagtatnagagcaagcctggcaccatggtgaaaccctgtctctacaaaaaattacaaaaattaactgggtgtggtgccggcacctgtaaccccagctactcagggggctgagcacgagagtcacttga

SEQ ID NO: 50464 - DNA, 342 bp, Homo sapiens
  misc_feature 304: n = A,T,C or G
gggaatctgacgcggatgcggcatggtgatcaagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgctctgaaagacctttctctggaagaggagctgcattgtagngtctcaaagacacaataaacttcctatggctgcactgt

SEQ ID NO: 50465 - DNA, 274 bp, Homo sapiens
  misc_feature 23, 55, 114, 229, 265: n = A,T,C or G
acttgcttttaaatccgtgatgntggggctattggcaagccatttggaacttggnacaaaattaagctgtattcatcctacccatctaagtaatcttttgataatcagatattnaaatgtaaaaattaaaaaattctaaaatgagtaagagaagatatgaatgaatatatcagtatggtgggagttgctctgaaccatttgtggttcaggatgctgcctgatttgccanaagaaaaaaagtaaaaatattagcatggtgataagntatgaagcc

SEQ ID NO: 50466 - DNA, 327 bp, Homo sapiens
aaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaacagtggatgttatcattgagaaaacaatgggctggaattaat

SEQ ID NO: 50467 - DNA, 421 bp, Homo sapiens
  misc_feature 32, 47, 53, 136, 285: n = A,T,C or G
gcctattctagacagtttatataaatggaatnataaaatatttgctntgttgnggctgacttatttcacttagcatagtttcaaggttcatgcatgttgtggcatgtatcagtattttctttttttgccaagtaanattttatgaatgttgcatatttatctatcaagtgatggacatttgggctcttcctactttttagctattaagaataatgctgcgaacatgtgtgcataagtttttatatagaaatatattttaatttttttcaagtgtatatctagagnggaattaccagatcatatggtaagtatgcaattaatattttgaggactgccaaactgctttccaaagtgggtgcataattttacattcccaccagtaatatatgagagtaatacggagagacctctccatatcttt

SEQ ID NO: 50468 - DNA, 395 bp, Homo sapiens
  misc_feature 16, 34, 61, 301: n = A,T,C or G
cattctaacctaacantggaggatttgcccattnacacttttgagactttttggtggatgnaaataaccccattctttgcttgaacacagtattttcccaatagcactttcattgccagtgtctttctttggtgcctttcctgttcagcattcttagcctgtggcaataaagagaaactttgtgctacatgacgacaaagctgctaaatctcctatttttttaaaatcactaacattatattgcaatgaaggaaataaaaaagctctatttaaattcttttttaaattttcttcagttggnggtttttgggatgtcttatttttagatggtacactgtagaacactattttcagaatctgaatgtaatttgtgtaataaagtgtttcagagcatt

SEQ ID NO: 50469 - DNA, 192 bp, Homo sapiens
  misc_feature 12, 84: n = A,T,C or G
tgaaagacctgnaaaaatggcatgaataatctgcttccatcccgccagtttggtttcattgtactgacaacctcagctggcatnatggaccatgaagaagcaagacgaaaacacacaggagggaaaatcctgggattctttttctagggatgtaatacatatatttacaaataaaatgcctcatggactctg

SEQ ID NO: 50470 - DNA, 121 bp, Homo sapiens
gtcattctgaaaggacctttccctgtacttacctttcaacatgcttcaatcttatcaacgctacattttgtatttttcaaacaagtataaattctgcaataaagagatgtagttttttttt

SEQ ID NO: 50471 - DNA, 211 bp, Homo sapiens
  misc_feature 14, 27, 36, 51: n = A,T,C or G
caagataaggaagncatccctcctgancagcagagntgtgatctttgctgngaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 50472 - DNA, 427 bp, Homo sapiens
  misc_feature 395, 398: n = A,T,C or G
ataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaatttgcctgcattttcagaacatcttttgagcttctgtngangtaacctgactactagagatattcttatt

SEQ ID NO: 50473 - DNA, 369 bp, Homo sapiens
  misc_feature 47: n = A,T,C or G
gcagaagacacgcgctctccaccacccaacccaaaccatgagaattngcaacaggggaggaaaaaagaaccaaaacttccaaggccctgctttttttcttaaaagtactttaaaaaggaaatttgtttgtatttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttag

SEQ ID NO: 50474 - DNA, 525 bp, Homo sapiens
  misc_feature 44, 294, 475: n = A,T,C or G
tctccctactgctgctacacaagaccctgagactgacctgcagnacgaaaccatgaagagcctgatccttcttgccatcctggccgccttagcggaagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacnctacgccatggtttatggatacaatgctgctataatcgctacttcaggaagcgccgagggaccaaatgagactgagggaagaaaaaaaatctctttttttctggaggctgcacctgattttgtatccccctgtagcagcattactgaaatacataggcttatatacaatgctctttcctgnatattctcttgctggctgcacccctttttcccgcccccagattgataagt

SEQ ID NO: 50475 - DNA, 101 bp, Homo sapiens
gtataaaataaattatgttcttaatgcctcttaaaccacttacattcaaaggggaacagaaatcattctaagcaggaaaatacttccactttttttttttt

SEQ ID NO: 50476 - DNA, 128 bp, Homo sapiens
  misc_feature 64: n = A,T,C or G
ggaaatagcaatcaagaaattttacataactatgattaagatgttaaggacactagtggaaaangtagaaaatattcaataaaagatgattagtataagcagacagatgaaaattctaacaaagaacc

SEQ ID NO: 50477 - DNA, 483 bp, Homo sapiens
  misc_feature 25, 30, 48: n = A,T,C or G
caggactgacgcattatctatgatnatggnacagataattttgaagantccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgctgccaaagattttgcagacatacctaacttaagaagactcgattttacaggaaatttggatagaagatatagaagatggtactttttcaaaactttctctgttagaagaactttcacttgctgaaaatcaactactaaaacttccagtcttc

SEQ ID NO: 50478 - DNA, 297 bp, Homo sapiens
  misc_feature 40, 45: n = A,T,C or G
ggaacaacgcttattttggaagttcgaaggggctgtcgtntgtgnggccctgatcttcgcttgcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagt

SEQ ID NO: 50479 - DNA, 386 bp, Homo sapiens
ggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagataagaagaagccccacgggagccaggatgggactggtcgtgtttgtgcttttctccaagtcagcacccaaaggtcaatgcacagagaccccgggtgggtgagcgctggcttctcaaacggcgaagttgcctcttttaggaatctctttggaattgggagcacgatgactctgagttttgagctattaaagacttcttacacattg

SEQ ID NO: 50480 - DNA, 260 bp, Homo sapiens
  misc_feature 85, 86: n = A,T,C or G
ggacttccattcggctggttaaaagatgcactaaacctgatagaaaagaattccagaagattgccatggcaacagcaataggatnngctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtggg

SEQ ID NO: 50481 - DNA, 276 bp, Homo sapiens
  misc_feature 50: n = A,T,C or G
tctccagaagaggagaagaggaaacacaagaagaaacgcctggtgcagancccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 50482 - DNA, 353 bp, Homo sapiens
ttccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgcccatcgtgtatataaatgaagcagatttgatttttgtattcttacgtttctctgctttgtagttgtggctgtacttaaagaaatacagaatttcatatatttaaaaatgtttaaaatgtgacccacagaacattgtaa

SEQ ID NO: 50483 - DNA, 367 bp, Homo sapiens
  misc_feature 60: n = A,T,C or G
caggatatcaagaaaccagactgtgatgactgggagagcgggctgaatgcaatggagtgngcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttgcgggaatatctctttgacaagcacaccctgggagacagtgataatgaaagctaagcctcggctaatttccccatagccgtggggtgacttccctggtcaccaaggcagtgcatgcatg

SEQ ID NO: 50484 - DNA, 353 bp, Homo sapiens
  misc_feature 5, 28, 29, 42, 50: n = A,T,C or G
ttatncagaacccttgatgagactattnntaaacatactagnctgctganagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgcagattatattatctaacaattgaatattgtaaatatacttgtcttacctctcaataaaagggtacttttctatt

SEQ ID NO: 50485 - DNA, 532 bp, Homo sapiens
  misc_feature 42, 50, 110: n = A,T,C or G
gcaggagcctctctccctactgctgctacacaagaccctgtnactgaccngcaggacgaaaccatgaagagcctgatccttcttgccatcctggccgccttagcggtagnaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgagggaccaaatgagactgagggaagaaaaaaaatctctttttttctggaggctgcacctgattttgtatccccctgtagcagcattactgaaatacataggcttatatacaatgcttctttcctgtatattctctggctggctgcacccctttttcccgcccccagatgga

SEQ ID NO: 50486 - DNA, 357 bp, Homo sapiens
  misc_feature 55: n = A,T,C or G
aatacagcctctaacaaaactaggctgtcccgaacccctggtaatagaattgttnacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgccg

SEQ ID NO: 50487 - DNA, 461 bp, Homo sapiens
  misc_feature 411: n = A,T,C or G
tggcaaatatcatcatcggtgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgctagtagttctctccagggcaaatgaagctcacagttttgcaaggtggaaacctcttattcacatttgctttgattccccgatggagtagactgcctttgtccatacaggcaaagtaagggatattttaatatcatcctacttcttattagcattcatttgctatgtactgactcatttgnatgctcctgaacatccaaatagagacataagacactttatgacaatctgg

SEQ ID NO: 50488 - DNA, 353 bp, Homo sapiens
acagacctatggtgcccatttagttatctaattgtccctgtaagccttcaaaaatgttagaaatgacctttggcacataaaaactgtccccgaaattgcttcttgcatctttgcttcatctgacttgcaaccctattcttgattcagaatgttttaagttttcaacaggttgtactaacatgatatgtctttaataggaattttagcaagttgacaccattttgagttaagaattgtgacttgtttaaatgaatatgcttatttgttaaaataacatattatggagaatggagaagtatccagaatgtataaacattctatattgttagctaaatagtttttaagtcggtctc

SEQ ID NO: 50489 - DNA, 305 bp, Homo sapiens
aagtgtcttggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcct

SEQ ID NO: 50490 - DNA, 444 bp, Homo sapiens
  misc_feature 372: n = A,T,C or G
tttgctgcgtctactgcgagaatgaagactattctcagctatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgtatccaggagaatgggctcttggtgaaatccgaaatttctnggggtgaaaaatatatccgcaggttcgggatgagaccaggggttgcttggtcagtatctcaagcccagaaag

SEQ ID NO: 50491 - DNA, 358 bp, Homo sapiens
  misc_feature 18, 118: n = A,T,C or G
atatcagctgtagttggntaattccaagtgctgatagtactattcatcttttttattattgtgtcagatgaaacaaatgccaagttgcaaaatatgcagatttttattatataatggntttaggcataaattattaacaagccatgccttatgtgtttcatcttatatttttctttagaactaaactataacagattttggaaaatgatttgacttgcttgctcacttgattgacttggcagatatttgaatgatggtattacctagattctaatccttgattctagttatataataaataatatagaatatgaaaatatgtttgggcatttactgtttatattatgtagtagcctcc

SEQ ID NO: 50492 - DNA, 447 bp, Homo sapiens
  misc_feature 395, 399: n = A,T,C or G
tatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttgcattgttgtaaacaaacaagttaagggcaagattcttgccaagagaattaatgtgcgtattgagcacattaagcactctaagagccgagatagcttcccgaaacgtgtgaaggaaaatgatcagaaaaagaaagaagccaaagagaaaggacctggttcaactaaagcgccagcctgctccacccagagaagcacactttgtgagaaccaatgngtanggagcctgagctgctggacctattccctatgaattcatggcataatag

SEQ ID NO: 50493 - DNA, 370 bp, Homo sapiens
ccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtaggag

SEQ ID NO: 50494 - DNA, 330 bp, Homo sapiens
  misc_feature 28: n = A,T,C or G
ggaaatcttataattagtgtcgtatttntctgcaaaatagtgaattggtacttgggagacttctgttctttgttgaaaaaaattgcctttgttttgaaattatatcacctgtgttctgaactaaaatgatgggaggtcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctg

SEQ ID NO: 50495 - DNA, 124 bp, Homo sapiens
  misc_feature 22: n = A,T,C or G
cgtgatggctcatgattgaaancccagggctttggaaggccaaggtgggaggattgcttgaagccaggagttcaagaccggtctgggcaacatagccagatcccatctctacaaaaaaattttt

SEQ ID NO: 50496 - DNA, 338 bp, Homo sapiens
tggagctgctggacccatcacagagtcttcaggcttcctggcctattatgagatctgccagttcctgaaaggagccaagatcacgcggctccaggatcagcaggttccctacgcagtcaaggggaaccagtgggtggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttgctccctgtgaaggattaacttacagagaagcagcaagatgacc

SEQ ID NO: 50497 - DNA, 353 bp, Homo sapiens
atgcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggctgcttgtcttctgaacgttggtcaaatgtgttttggtcctggag

SEQ ID NO: 50498 - DNA, 362 bp, Homo sapiens
  misc_feature 46, 54, 302: n = A,T,C or G
tgccagtaattatcatttttgcaacggaatatggataccacatagnactttggngttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctatnggaacccaataggcgtcattgatggcggcaagccatagctttcaagttttaataaaatgc

SEQ ID NO: 50499 - DNA, 336 bp, Homo sapiens
aggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaattttgctttgaacttttagttatgcacagactgataataaacctctaaacctgcccagcggaagtgt

SEQ ID NO: 50500 - DNA, 368 bp, Homo sapiens
caagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggcacaaagaagaaggaggaacagttgaagcttctcaaggagaaatatggcatcaacacagatccaccaaaataaatgtttct

SEQ ID NO: 50501 - DNA, 413 bp, Homo sapiens
  misc_feature 391: n = A,T,C or G
atcttccaagtgttgaattcttggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagtttttttaacctgtttatataattttgcagcagaagccaaattttttgnatattaaagcaccaaattcatg

SEQ ID NO: 50502 - DNA, 256 bp, Homo sapiens
  misc_feature 112: n = A,T,C or G
gtcacacatgaaagaagccatgatcaagcttgggttccacttgctctgcttcttcatgtatctttatagtatgatcttagctttgataaatgactgaagctggagaagccgnggttgaagtcagcctacactacagtgcacagttgaggagccagagacttcttaaatcatccttagaaccgtgaccatagcagtatatattttcctcttggaacaaaaaactatttttgctgtatttttaccatataaagtattt

SEQ ID NO: 50503 - DNA, 362 bp, Homo sapiens
  misc_feature 123, 126, 182, 200: n = A,T,C or G
acaaacccgatatggctgagatcgagaaattcgataagtcgaaactgaagaagacagagacgcaagagaaaaatccactgccttccaaagaaacgattgaacaggagaagcaagcaggcgaancgnaatgaggcgtgcgcggcaatatgcactgtacattccacaagcattgccttcttatnttacttcttttagctgtntaactttgtaagatgcaaagaggttggatcaagtttaaatgactgtgctgcccctttcacatcaaagaactactgacaacgaaggtcgcgcctgcctttcccatctgtctatctatctggctggcagggaaggaaagaacttgcatgttggtgaaggaagaa

SEQ ID NO: 50504 - DNA, 257 bp, Homo sapiens
ggtggtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcc

SEQ ID NO: 50505 - DNA, 241 bp, Homo sapiens
  misc_feature 21, 43, 69, 121: n = A,T,C or G
gattcatgagatctatactgntggaaaacgcttcaaagaggcnaataacttcctgtggcccttcaaatngtcttctccacgaggtggaatgaagaaaaagaccacccattttgtagaaggnggagatgctggcaacagggaggaccagatcaacaggcttattagaagaatgaactaaggtgtctaccatgattatttttctaagctggttggttaataaacagtacctgctctcaaattg

SEQ ID NO: 50506 - DNA, 441 bp, Homo sapiens
  misc_feature 15, 58: n = A,T,C or G
cccattagcaaaggntgattgcacttgccaacactaacacctgtaataaatatggagncagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgccttcacatctcactaacaagtttgaggacaagactgtggcatatacaggag

SEQ ID NO: 50507 - DNA, 344 bp, Homo sapiens
  misc_feature 231, 243, 244, 256, 274: n = A,T,C or G
caagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggngggattttttgnntgtttgttttgntttgttgttgtttgttgnttgtttttttgccactaattttagtattcattctgcattgctaagataaaagctgaagttactttatgtt

SEQ ID NO: 50508 - DNA, 391 bp, Homo sapiens
acaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagagtttggtgtggacgttggccctgtttgctttttataaaccaaactctatctgaaatcccaacaaaaaaaatttaactccatatgtgttcctcttgtctaatcttgtcaaccagtgcaagtgaccgacaaaattccagttatttatttccaaaatgtttggaaacagtataatttgacaaagaaaaatgatacttctctttttttgctgtccaccaaatacaatct

SEQ ID NO: 50509 - DNA, 113 bp, Homo sapiens
aggctttttcttatttccaaatacttgagaaattaccttttggtttacaaatctatgatcaacttattccattaaatagatacattaaaaaaattaaaaactgattcttctgc

SEQ ID NO: 50510 - DNA, 391 bp, Homo sapiens
  misc_feature 14: n = A,T,C or G
agccaccaaaaatntaacaaatttgataacctgtcacgtgtaagttcagaaagcactttggtcttaattggtgacttgggggttatttggtataaatataggttctttttctaaaattattgccagtatcctccaaataattgccccttcaaatgtttcatctaaaggtgacagcttgtgggcagaaccatgcacaggaagtgcctgccagtgggtgttaggagatgtaggtggagctgtgatagccaaccaaaagctatccccttctcgcccagaaaagccacgtgctttgtggcgctacttgaaatctgactctgcacctacatatgtagtaaaataagagactttggcactttaatttttagatatctcaagtttcactagattcaat

SEQ ID NO: 50511 - DNA, 179 bp, Homo sapiens
  misc_feature 135: n = A,T,C or G
gctaaatagtaatacaaatgacaaactgcattaattttactaattataaaagctgcaaagcaggactggtggcaagtacacagccctttttttgcagtgctaacttgtctactgtgtattatgaaaattactgtngtccccccacccttttttccttaaataaagtaaaaatgacaccc

SEQ ID NO: 50512 - DNA, 121 bp, Homo sapiens
gacactaatacagatgattaaggaaaacagctgatctttggggaagggagctaccaacactttatacacacacacacgtgcacacacacacacacacacacactatatatatatatattat

SEQ ID NO: 50513 - DNA, 302 bp, Homo sapiens
  misc_feature 40, 46, 49, 61, 75: n = A,T,C or G
atatatacaattaaaatatctgtataattatgttttaatnaagttnatntcaacagatatnatatgaaatgcagnttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttg

SEQ ID NO: 50514 - DNA, 238 bp, Homo sapiens
  misc_feature 185: n = A,T,C or G
tcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggnggacagattctagtgctgagaagaaacacgtttggtttggagagtccatggat

SEQ ID NO: 50515 - DNA, 355 bp, Homo sapiens
accttttgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacggctctttggacactaggaaaaaaccttgtagagagagtaaaaaatttaacacccatagtaggcctaaaagcagccaccaattaagt

SEQ ID NO: 50516 - DNA, 269 bp, Homo sapiens
  misc_feature 9, 142: n = A,T,C or G
gcagcccanaacaatattgcagaggctatactagatagaaacttcatctactgtggcagatgggatggcagaatgtattgatacacatgcagtttggtttgtggcttgaggtggattgaaaaggtagatctaatttgatttngaatattttctttctgaagtatataggccagtcagtcatgagctagacagagattttggagattttaggagagagaagacaaaagatcaatctctcaaagagtgggaaaataaatttactatgaaag

SEQ ID NO: 50517 - DNA, 358 bp, Homo sapiens
  misc_feature 12: n = A,T,C or G
aagattcccganagtaaatcatctctccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggttgggatcaataggaaagcatatgcagccaaccaagatgcaaatgttttgaaatgatatgacct

SEQ ID NO: 50518 - DNA, 252 bp, Homo sapiens
  misc_feature 26, 27, 43: n = A,T,C or G
gagagaaacaagcatctattgcagtnnctttttgcgtacaaangatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactatt

SEQ ID NO: 50519 - DNA, 351 bp, Homo sapiens
  misc_feature 86, 119: n = A,T,C or G
aaaaaaagtaaaaggtgctgctttctaaaatattaattgccttatatttgaaagtgccattgcaatcgtaagtagactatgtattncctataatgatgtctgatatttaaataggaaancagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgcatatgcatagttttaatacaattcacatgatttcta

SEQ ID NO: 50520 - DNA, 256 bp, Homo sapiens
  misc_feature 30, 59: n = A,T,C or G
aaaaaatttgatttagcattcatattttcnttcttattcccaattaaaagtatgcagantatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaag

SEQ ID NO: 50521 - DNA, 227 bp, Homo sapiens
  misc_feature 43: n = A,T,C or G
aagatgttttctctttgaaagatagagattaatacaactactnaaaaaatatagtcaataggtactaagatattgcttagcggtaagtttttaacgtaattttaatagctcaagattttaagagaaaatatgaagacttagaagagtagcatgaggaaggaaaagataaaaggtttctaaaacatgacgggaggttgagatgaagcttcttcatggagtaaaaaatg

SEQ ID NO: 50522 - DNA, 428 bp, Homo sapiens
gaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattggggaaaattctgttgcaagaccattaacatttagtatgactcctttttact

SEQ ID NO: 50523 - DNA, 348 bp, Homo sapiens
ataaggctgaaacaattgaactgaaatatgaactgctgcctaccttaggggagacagtgttttgcagtttgatttcagtgaagttaactgtgtgctttaaaaaagtgacttcaaagaaaattaggagaagctgtagtttctacaacatatcattcaagagatccaggatgcaacctaaaattacttactgcatgacgaaacacaatcaacagagatcaactgcaggaatacctggatgatggaatagcaagcaatgatttgatgaaagtagctgttataagtgtgcccaaggacataaagggaaatacatttgctcatcatatagggaaagattggaaatcccagcag

SEQ ID NO: 50524 - DNA, 385 bp, Homo sapiens
  misc_feature 324: n = A,T,C or G
ggatgcattttataaacttagagaatttagaaaactcataaataaggaaaattgggagttcttatccatgatcatgaggtacattggagaagagttggctgggcgcaggggctcatgcctataatcccagcactttgggaggccgaggcgggtggatcatttgaggtcagcagtttgagaccagcctgacgaacatggtgaaaccccgtctctactaaaaatacaaaaaattagcccggcttggtggtgggtacttgtaatcccagctactcaggaggctgaggcaggagaatcacttgaacctgggaggcagaggttgcagtnagctgagattgcaccattgcaccctagcctggcagcaagagcgaaactccttctcaaaaag

SEQ ID NO: 50525 - DNA, 283 bp, Homo sapiens
  misc_feature 238: n = A,T,C or G
agtgaatttgacacctattttttagtgatgaaatttttctttgagaactggcaaggatgcaggtcagctgtttgcagtttttagcctgattttggggtctatagagattgctttattggatacttcaagtcattcttgcttgcacttcccctattgacacatgaaagctgtgttggtgttttattgacatacttcagatgcacataggaatagaagtgtgtataaatctagctttctntatgatgttctgataatacgagaattgaaaactttaccttctctt

SEQ ID NO: 50526 - DNA, 411 bp, Homo sapiens
  misc_feature 21, 35, 38, 42, 46, 47, 299: n = A,T,C or G
tagacaataaagaactgaagngctcactactcagnganttgnaaannttgatgcttgtataaatgccagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaagaaaatatttataggaggaaatgattaatttgatattctttagtgaacttgtttaattcctcagngggtgtgcatatttcatggggaatattcaaatatctatgggaaatattttgaccctttatatttgtctaaaataagtcaaaatgtgaaaataatattaaatctaagatattt

SEQ ID NO: 50527 - DNA, 101 bp, Homo sapiens
  misc_feature 16: n = A,T,C or G
gttttaagttattagnttttaaaatcagtactttttaatggaaacaacttgaccaaaaatttgtcacagaattttgagacccattaaaaaagttaaatgac

SEQ ID NO: 50528 - DNA, 323 bp, Homo sapiens
  misc_feature 7: n = A,T,C or G
ttatgcnaatacagcaaacttttatttaagtagataggagaatatgtttaaaatattaggaatcctagaccatattttcaagtcatcttagcagctaggattctccaatggaagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggctaaattatgaggtaccaagattgtttctttgttctttttttcaaatt

SEQ ID NO: 50529 - DNA, 259 bp, Homo sapiens
  misc_feature 40, 143, 189, 201, 249: n = A,T,C or G
agtaagatgcaaagaggttggatcaagtttaaatgactgngctgcccctttcacatcaaagaactactgacaacgaaggccgcgcctgcctttcccatctgtctatctatctggctggcagggaaggaaagaacttgcatgtnggtgaaggaagaagtggggtggaagaagtggggtggggacgacagngaaatctagagnaaaaccaagctggcccgaggtgtcctgcaggctgtaatgcagtttaancagagtgcca

SEQ ID NO: 50530 - DNA, 188 bp, Homo sapiens
  misc_feature 42, 126, 143, 180: n = A,T,C or G
agaatgctgcaattcagggctcttcaaacttgtttgatatanaatatgttgtcttttgtttaagcatttattttcaaacactaaggagctttttgacatctgttaaacgtctttttgtttttttgntaagtcttttacatttnaatagtttttgaagacaatctaggttaagcaagagcnaagggcca

SEQ ID NO: 50531 - DNA, 329 bp, Homo sapiens
  misc_feature 64, 83, 87, 205, 244: n = A,T,C or G
gggccaggggaacccgtgagtatcactctcaaatgagattaaaaacaaggaagcagagaatggncagagaatgggattcagantggnaacttgtggggatgagagtgaccaggctgaactgggaagtggaaaaaggagttggagtcactggcacctagaagcctgcccacgattcctaggaaggctggcagacaccctggaaccntggggagctactggcaaactctcctggattgggcctganttttttggtggggaaggctgcctggggatcaaccttccttctgtgtgtggctcaggagttcttctgcagagatggcgctatcttt

SEQ ID NO: 50532 - DNA, 421 bp, Homo sapiens
  misc_feature 35: n = A,T,C or G
gactggtatggaggtgactgctttgtaaggttttntttgattctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgac

SEQ ID NO: 50533 - DNA, 417 bp, Homo sapiens
ggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgctttttttttccagcaagtatccaaccaacttggtctgcttcaataaatctttggaa

SEQ ID NO: 50534 - DNA, 340 bp, Homo sapiens
  misc_feature 46: n = A,T,C or G
taaactctcattttatgaaagacctgggcttagacagtttggaccnagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgcatgtgttttactctttgaaaataaatctataaaacct

SEQ ID NO: 50535 - DNA, 243 bp, Homo sapiens
ataattttcattttttggttgtgcagttccttggctactgtttttcttttacttcagttttttaaaaatctcaaatgaaaaagtcttcgatacaatattgttaagctgtattataagtattgttacacagggttatgcaattcctggcctggagcatttttgaaattcaaattgtctgcctgtggagcaggcagtgattttgtccaaaactttgtatacacatttggagaaaagtactttata

SEQ ID NO: 50536 - DNA, 473 bp, Homo sapiens
tacccagactcctgcgcagtacttggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgcattggatgtatttgcttatattcttataattttaaatgagggcacagtgaaatgaaaattttatactctatggttctggtattttaaatccttaacagcaaaatatttgcctttaattctttttatatatactctcagagaat

SEQ ID NO: 50537 - DNA, 393 bp, Homo sapiens
  misc_feature 201, 269, 369: n = A,T,C or G
aacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgntgcagcaaaataatagcctcggttctatgcatatatggattagctataaaaaatgtcaataagattgnacaaggaaaattagagaaaggcacatttagggtttattttttacacttggccagtaaaatagggtaaatcctatgagaatttttaaagacttttttaagntcctaaatctgtgtgggtattgtg

SEQ ID NO: 50538 - DNA, 293 bp, Homo sapiens
gataagcatcaaacttggagaaatattcacatataatcactaaatggttaggtattcagaaaatataaagaacttctgtagccaaaagtaccatttatgaatctacttattgatggatgttttctgaacttcttttgcccagaggaaaaatagtgcattaaaaagcttctgtccggccgggtatggtggctcacacctgtaatcccagcactttgggaggctgagataggtggatcacctgaggtcaggagtttgagaccagcctgccaacatggtgaaaccccatctctact

SEQ ID NO: 50539 - DNA, 381 bp, Homo sapiens
  misc_feature 28, 185, 284: n = A,T,C or G
agagataccatcagagaacaaacactantgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagntcttctttctttcttaagccctttgctctggaggaagttctccagcttcagctcaactcacagcttctccaagcatcaccctgggagtttcctgagggntttctcataaatgagggctgcacattgctgttctgcttcgaagtattcaataccgtcagtattttaaatgaagtgattctaagatttggtttgggat

SEQ ID NO: 50540 - DNA, 315 bp, Homo sapiens
gttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaag

SEQ ID NO: 50541 - DNA, 370 bp, Homo sapiens
  misc_feature 167: n = A,T,C or G
aaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactccngaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatata

SEQ ID NO: 50542 - DNA, 213 bp, Homo sapiens
agaattcttgtttttagaatacatgaggtgagacgagtccctgtactttgtttgtatgtgcttacccctccagcaggtagttgttctaattataaactgcaactgttttaagtgatcaaaaatttcatataccaaacctgacaggaagggaaccaaaaggcttgggggtggggagaagattacacatcatttacttggatattgcaaatcata

SEQ ID NO: 50543 - DNA, 105 bp, Homo sapiens
  misc_feature 16, 100: n = A,T,C or G
gtaattcagaaaaacncaagatttaagttaaaaagtggtttggacttgggaacaggactttatacctcttttactgtaacaagtactcattaaaggaaantgaac

SEQ ID NO: 50544 - DNA, 177 bp, Homo sapiens
  misc_feature 159: n = A,T,C or G
aaatgaatattatccctaatacctgccaccccactcttaatcagtggtggaagaacggactcagaactgtttgtttcaattggccatttaagtttagtagtaaaagactggttaatgataacaatgcatcgtaaaaccttcagaaggaaaggagaatgntttgtggaccactttggt

SEQ ID NO: 50545 - DNA, 327 bp, Homo sapiens
tttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcggaggacaagagaaatcatgtttattcctcaggaatactgaagtgccctggagtaagctgcattcttctgtaacaatgttatcagtaatgctttaaactccagcacctggttatgcatttgaaaccaagtctgtttcttg

SEQ ID NO: 50546 - DNA, 299 bp, Homo sapiens
  misc_feature 20, 30: n = A,T,C or G
agttgtttggtcttgcgggnctgtcagggntggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaagaataaaagtgctgcgtaatc

SEQ ID NO: 50547 - DNA, 458 bp, Homo sapiens
  misc_feature 52: n = A,T,C or G
gaagtattcaataccgctcagtattttaaatgaagtgattctaagatttggnttgggatcaataggaaagcatatgcagccaaccaagatgcaaatgttttgaaatgatatgaccaaaattttaagtaggaaagtcacccaaacacttctgctttcacttaagtgtctggcccgcaatactgtgggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggataattatggtgggtgattattttttatactgatgtgccaaagcttactactgtggaaagacaactgtttaataaaagattacatccc

SEQ ID NO: 50548 - DNA, 357 bp, Homo sapiens
gcgccggctgctcagaagataccgttttctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccagggaagcacgcaagcgccggtgaagagcgcctccaggccaagaaggaggagatcatcaagactttatccaaggaggaagagaccaagaaataaaacctcccactttgtctgtacatactggcctctgtgattacatagatcagccattaaaataaaacaagcct

SEQ ID NO: 50549 - DNA, 374 bp, Homo sapiens
  misc_feature 33, 49: n = A,T,C or G
aaaaagccaaaatactaattatttctttgtagngagtaaaggaatgttnttaaaagacaaaaacccaactctttgtggatttttatcaactctttactcagagccgctctccaatgcaggtcacactccaattatgatggaagatattttttatacttaattgcagtagggactcattcccagacaaagcaatagtcacgacttcatggaaccaatcaatggattgttttttgaagactggcaataaagctgccattcaattccaaatactggttttaaggtatagccactgatattctttcatgtttagaaattctttctgttattattcaagaaaatgtttttaatcatgctaataaacttttttggagatc

SEQ ID NO: 50550 - DNA, 470 bp, Homo sapiens
  misc_feature 53, 313: n = A,T,C or G
ctctatatgggcactttaaaggaagaaaagatatgtttctcattctaaaatangcattataatttagcagtcccatttgtgattttgcatatttttaaaagtacttttaaagaagagcaatttccctttaaaaatgtgatggctcagtaccatgtcatgttgcctcctctgggtgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagngggcagaatacttctcacagctcaaagataacagtgatcacattcattccataggtagctttacgtgtggctacaacaaattttactagcttttcatggctttccatgaacgaagtgagaaaatgatttccctttgcaggtgcacacagtttggtta

SEQ ID NO: 50551 - DNA, 100 bp, Homo sapiens
  misc_feature 9, 98: n = A,T,C or G
tggaacagngctactgatcaccaagtagccacaaaatataataaaccctcagcacttgctcagtagttttgtgaaagtctcaagtaaaagagacacanac

SEQ ID NO: 50552 - DNA, 113 bp, Homo sapiens
  misc_feature 3, 75, 100: n = A,T,C or G
aangtgaatgttggcttttttcctattctgcactcattctctaaatttaggcctatcgaagatttggcatagtanaaggaatagcaaggagtttggtagnttttcccaatgag

SEQ ID NO: 50553 - DNA, 270 bp, Homo sapiens
  misc_feature 117: n = A,T,C or G
gcctccctccggaaaatggtgaagaaaattgaaatcagccagcacgccaagtacacttgctctttctgtggcaaaaccaagatgaagagacgagctgtggggatctggcactgtggntcctgcatgaagacagtggctggcggtgcctggacgtacaataccacttccgctgtcacggtaaagtccgcatcagaagactgaaggagttgaaagaccagtagacgctcctctactctttgagacatcactggctataataaatgggttaat

SEQ ID NO: 50554 - DNA, 398 bp, Homo sapiens
gaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgag

SEQ ID NO: 50555 - DNA, 310 bp, Homo sapiens
  misc_feature 35, 40, 122: n = A,T,C or G
ctttaaaccatttatctggatttttatgttttatnagcantttcaagaagacggattatctagagaataatcatatatatgcatacgtaaaaatggaccacagtgacttatttgtagttganagttgccctgctacctagtttgttagtgcatttgagcacacattttaattttcctctaattaaaatgtgcagtattttcagtgcaaatatatttaactatttagagaatgatttccacctttatgttttaatatcctaggcatctgctgtaataatattttagaaaatgttgggaatttaagaaataa

SEQ ID NO: 50556 - DNA, 405 bp, Homo sapiens
  misc_feature 9, 30, 54: n = A,T,C or G
gaaaatgtncatctgtgcagaggatgcatnttcttccattaattgctgggaaanacggcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggcattgcatttaaaaagcatataactgtacttgacttgatgaggga

SEQ ID NO: 50557 - DNA, 391 bp, Homo sapiens
  misc_feature 278, 284: n = A,T,C or G
ttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacangggatnctcctccttcatcctgtaaagtcaacaataaaaaccaaattatggggctgcttttgtcacactagcatagagaatgtggtggaaatttaactttgaagcttgtatgt

SEQ ID NO: 50558 - DNA, 156 bp, Homo sapiens
  misc_feature 14, 34, 84, 105, 126, 133: n = A,T,C or G
aactaatttaaaanattatcatccatttcttgtnattatgaatagcaataccatcttttttcttcaaaaaaaaaaagacatcangatctatgctattttcaactngtttcctgggcttctattaanggaaatngatttttcaagattaatgtaaaa

SEQ ID NO: 50559 - DNA, 390 bp, Homo sapiens
  misc_feature 35, 80, 167, 243, 246, 295: n = A,T,C or G
gacccttcccctgtaccccaatttcaagcttattntaggaagccttgaactaccatgtatcctggctcctagctgagttnattagaggtatggagcagtgcaacttaaactcaagttgcacttgcattttgaattttaaaatgatggttttatctgttgtgtgaagnggttcacccttgaggaccaggagcctccatatcctgactgaaaaccttttctgagacttagagtaacagtactttnggnccttgagtctcctgctccagatccaaatgaccttgacttttctgcttgngaattcgtagtccaatcagctgaaattaaatcacttgggagggacgcatagaaggagctctaggaacacaagtgccagtgcagaagtttcttcag

SEQ ID NO: 50560 - DNA, 396 bp, Homo sapiens
  misc_feature 13: n = A,T,C or G
gaccgagtattgnttgaaaggagtgctgcgtgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtaggttctagatgacaaggattatttcctatttagagatggtgacattcttggaaagtaccgtaggactgaaataagtcactattgaaatggcatcaacatgatgctgcccattccactgaagttctgaaatctttcgcatgtaaataatttccatatttctcttttataataaactaatgataactaatgac

SEQ ID NO: 50561 - DNA, 320 bp, Homo sapiens
  misc_feature 104, 109, 161, 179, 302: n = A,T,C or G
acccacatgacttattatgcataaagccaaatttccagtttaagtaattggctacaataaaaagaaattttgcctgccattttcagaatcatcttttgaagctncctgntagatgttaactgagctactagaggtattcttatttcactaaatgtaaaatntggagtaaatatatatgncaatatttagtaaagcttttcttttttaatttccaggaaaaaaataaaaagagtatgagcttctgtaattcattgagcagttagctcatttgagataaagcaaatgccaaacactagctctgnattaatccccatcattac

SEQ ID NO: 50562 - DNA, 261 bp, Homo sapiens
  misc_feature 40: n = A,T,C or G
tgctcatccacataccctgacctggccccctcagtgttgncaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagtctaggaaaataaaacccgtgattacc

SEQ ID NO: 50563 - DNA, 325 bp, Homo sapiens
  misc_feature 31, 95: n = A,T,C or G
tttgtcattgccacttcaaccaaaatcgatntcagcagtgtaaaaatcccaaaacatcttactgatgcttacttcaagaagaagaagctgcggangcccagacaccaggaaggtgagatcttcgacacagaaaaagagaaatatgagattaccggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 50564 - DNA, 132 bp, Homo sapiens
  misc_feature 42: n = A,T,C or G
acccatgaagcgcatttggatgagatagaagaaattgttttntaaaaagtttaagtaccaaaggtagtctagtctagaacgataagttaatacgtgttggcttttctaatttgtactgtaacatccttatac

SEQ ID NO: 50565 - DNA, 382 bp, Homo sapiens
  misc_feature 20, 38, 39, 190, 195, 200: n = A,T,C or G
gtttactaagcattgtaaanttatttataactgccatnnccaactacatccttatgatgtttttaacaataaaattaaaacaactgttaaactaaaaaccacaccgttttccagtacttgatctctgagctacaatactcactaaatataattttccaatcaaaatattctattctatattctaagggtnaatangtgantatagtgtccacttgccaccatttttttaaatcaatggacttgaaaagtattaatttagatggatgcgcagatataccctcagttcagtcatagattggagtttgcatataataatgtaaatgtatgtcgacactattctaaatagttctattatgactgaaatttaattaaataaaaaagg

SEQ ID NO: 50566 - DNA, 256 bp, Homo sapiens
  misc_feature 153: n = A,T,C or G
tgaagaatgacatctatggtgaagactaacagcttgtacatgtgtattatgtaattaggacacatttaaaatttggcaaataatgcatataatgaaatcaatattgtaaggcctgcttttgtaatgaaaatggagagaatgaagagcgctgtncagtaaatactccccttcacctttctaattattaacttgttttcatggagtggctattcagcattggcagttaccacattctgttcaatttaaccaaactggc

SEQ ID NO: 50567 - DNA, 143 bp, Homo sapiens
agatggcgtaacggggaatagttttcaacgtctatttcattccctgcttcagaggacctctttaatctttgattttggtccctgtttctaagaaaagcaactgaaaaggtcgtaataccgcccctgagaaaaaaggagcagcg

SEQ ID NO: 50568 - DNA, 150 bp, Homo sapiens
  misc_feature 52, 69: n = A,T,C or G
ttgaccacttccacctatgaaaattatctgaacattattcagatttaagagntcatgggagcaggtggnacagaacctagtgttgaatataatttttgtgccatgcttgaatgtattttgacggattagcaaaataaaagtgaacctccg

SEQ ID NO: 50569 - DNA, 480 bp, Homo sapiens
  misc_feature 6, 28: n = A,T,C or G
aaaatntataccacctgggatacaaganatgaaagcactacattttctgaggctgaacaacaacaagatacggaacattcttccagaagaaatttgcaatgctgaagaggatgatgactcaaatctggaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggatagtctctaggagtttattaatagtaaaggtaaaatctctcagttcctacctctagaaagaggccatctcac

SEQ ID NO: 50570 - DNA, 356 bp, Homo sapiens
atttcacaaagagaaacctgagaaccactgcagtaaggaagtggaaagtttagaaatgctaccattgcctccacctgccaaatataaattaatgtgagctttttgagagacgcataacttactttgtctctgacttctccagttgtacccattttctcatttgttttgcacttacttgtatactatatgctggggaaaaagacaaaaatccctgtctttatttagtttgtaagcattcttcatttcccgaaggttggagaccttcggtctacaggtatcacagaaagtttaggaagtatgtaagccttaaaaggaaaaaatagtaagctttactctagcaaatgagtttatttgat

SEQ ID NO: 50571 - DNA, 202 bp, Homo sapiens
  misc_feature 162: n = A,T,C or G
tatgcactgtacattccacaagcattgccttcttattttacttcttttagctgtttaactttgtaagatgcaaagaggttggatcaagtttaaatgactgtgctgcccctttcacatcaaaaaactactgacaacgaaggccgccctgcctttcccatctgnctatctatctggctgcagggaaggaaagaacttgcatgtt

SEQ ID NO: 50572 - DNA, 199 bp, Homo sapiens
gattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatct

SEQ ID NO: 50573 - DNA, 139 bp, Homo sapiens
  misc_feature 17, 51, 67, 98: n = A,T,C or G
ctagggccctttcaggngggaggagcattctcagccaaagacctgaggtgngcagagctgaggaaanaggaaagtgtggctagagtgagcttctttgntatataggttggaaatgccctctgccttctttagaaggaag

SEQ ID NO: 50574 - DNA, 430 bp, Homo sapiens
  misc_feature 36: n = A,T,C or G
cactgcgcagaccagacttcgctcgtactcgtgcgnctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaagccgcgcctgcctttcccatctgtctatctatctggctgcagggaaggaaagaacttgcatgttggtgaaggaagaagt

SEQ ID NO: 50575 - DNA, 136 bp, Homo sapiens
  misc_feature 28, 50, 51: n = A,T,C or G
aagcgttcagtgatgtggggtgaaaagntactacctgtcaaggtttgtgnnaccctcctgtaaatggtgtacataatgtattgttggtaattattttggtacttttatgatgtatatttattaaacagatttttac

SEQ ID NO: 50576 - DNA, 330 bp, Homo sapiens
  misc_feature 20, 103: n = A,T,C or G
tggagctcgcaaggacactnttcaataggatggactttgaaggcttggggttggcagtagattgggaccaccacctgcctccaccagctgccaagactgtggntgagaacctccccaggacagtcatcagaggctctcaggctgagctcaagtgccccgtgtgcttttggaatttgaggaggaggagactgccattgagatgccttgcatcaccttttccattccagctgcattctgcctgctaagcaagacaaattcctgtcccttgtgccgctatgagctgcccactgatgacgacacttatgaggagcacagacgagataaggctcg

SEQ ID NO: 50577 - DNA, 158 bp, Homo sapiens
  misc_feature 30: n = A,T,C or G
agagaatacagagggcaaaagatggatccnaagtaactaaacaggagcccacaagacggtctgccagattgcaagcgaaacctgctccaccaaacctgacccaaaccaagaaaacatctgctaagaaagaacctggagcaaagattagcagaggtgct

SEQ ID NO: 50578 - DNA, 143 bp, Homo sapiens
gagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcg

SEQ ID NO: 50579 - DNA, 135 bp, Homo sapiens
  misc_feature 28: n = A,T,C or G
cagaaatgtcttttctagcaccaaagtnaggattaactggagaagcaagatgctggaggcaggaagaccagaaaaatagttcattgcaatagttcatgtgggaagtgagactactgcaaaacaggtcaatggcag

SEQ ID NO: 50580 - DNA, 192 bp, Homo sapiens
  misc_feature 34: n = A,T,C or G
ggcccgcagctgtaagaccaaggaagcactgcangcgcctgttgaagagcgcctccaggccaagaaggaggagatcatcaagactttatccaaggaggaagagaccaagaaataaaacctcccactttgtctgtacatactggcctctgtgattacacagatcagccattaaaataaaacaagccttaaaaa

SEQ ID NO: 50581 - DNA, 402 bp, Homo sapiens
  misc_feature 21, 40, 339, 342, 343: n = A,T,C or G
ccttggggagaagaccccggngctggtgaacgcggctgtnacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtgccactgaggtgttgatgtggttttatgtcggagagattataggcaagcggggcatcattggctatgatgtttgaagaccaatctttaacatctgattatatttgatttattatttgagtgtnggnnggccatgtgtgatcagactgctatctgaataaaataagatttggctaaaaaaaaagaaa

SEQ ID NO: 50582 - DNA, 483 bp, Homo sapiens
  misc_feature 12, 74: n = A,T,C or G
cggaaagccaangactgagagcaatgagcattccgatgttgattgatagccaggaactttccaaagtcagccgngaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggtatgtctatgttcattctatagaagaaatgcaaactatcactgaattttaatatttggtattctctcatgaat

SEQ ID NO: 50583 - DNA, 325 bp, Homo sapiens
ctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatg

SEQ ID NO: 50584 - DNA, 499 bp, Homo sapiens
  misc_feature 54, 206, 399, 417, 462: n = A,T,C or G
atgtggcacaagggaacactcattccttttgacagggtctgtcactgggtgggngatgaattatacagatgacatgtgcttttttttcttttttcaacctcaatggtattcctacaggaaatggataaccattttaactgtattttttgcagcccgtaccttcttgggaatacaattgtctaactttttatttttggtctggctgntgtggtgtgcaaaactccgtacattgctattttgccacactgcaacaccttacagatgtggaagatgtgaaatttgcatcaattatgactaccctaactcctcagaggattatattcatcgaattggaagactgctcgagaccaaaacaggcacagcatacactttctttacacctaataacataaagcaagngagcgaccttatctctgngcttcgggaagctaatcaaggcaattaatcccaagttgcttcagntgggtcgaagacagaaggtcaggtcggttccaggggg

SEQ ID NO: 50585 - DNA, 591 bp, Homo sapiens
  misc_feature 363, 521: n = A,T,C or G
ctttaatgggtattccttattccagtaacatttttatgtactcatctgctgtgaaaagtctttaggttcattaaaaaaacaggttttagaaatgatcttagatctaatatactgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgngatctttttatgattagatgaagaaaattttacaacttttaacaccccacaccaattttaggttcattacttttacacacaccattttatcacaaatgactcaagttttaatgaaggttataaattattggaacaaaatatgatcgctgggccaggangcatagaggaaagcggcaattagggtaacacttacatattataggggcccctttaaagggattcttttct

SEQ ID NO: 50586 - DNA, 534 bp, Homo sapiens
  misc_feature 435, 492: n = A,T,C or G
tcattgaaggagaaagaagtagacagtagacaaagttgttgttcaaagtataatcaagagtcaggcatccaattgaggtctgaacaatagcttttattcatgttctctcaccagtctgtgttacatgaagctttaatgatatttgatgattgaattcattttttaaaatagctgcattgcagaaaagtggtttgctattaaaatattacgtaccttaggagactgaggtggaaggattacttgagcccaggagtttaagacaagcctgggcaacatagcaagaccctgtctctaaaaataataataataataactgagcatgggtgcttccgctgtggccctgctacgtgggaggctgaggcagaaggatcactttgatgccatgaggtggaggctgccgtgaggcgggggtggtgccatgccctccagcctggntaaacaaagcaaaaccctgcctcttaaaaaagaaaaaataacgtacttgagtttggntcatacaggattaatggaaggaactaccaaagaattttactg

SEQ ID NO: 50587 - DNA, 586 bp, Homo sapiens
  misc_feature 42, 180, 492: n = A,T,C or G
aacaaacactaatgttaattgcccaattgagtgcttcatgcntttagatgtacaggctgacagagaagattcccgagagtaaatcatctttccaatccagaggaacaagcatgtctctctgccaagatccatctaaactggagtgatgttagcagacccagcttagagttcttctttctntcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatctggtttgggatcaataggaaagcatatgcagccaaccaagatgcaaatgttttgaaatgatatgaccaaaattttaagtaggaaagtcacccaaacacttctgctttcacttaagtgtctgggcccgcaatactgnaggaacaagcatgatcttggtactgtgatattttaaatatccacaggtacttacttttttccaaatgatcctaagaaatgcctagaaatatctt

SEQ ID NO: 50588 - DNA, 100 bp, Homo sapiens
ccaaagaggaacagctctttggacactaggaaaaaaccttgtagagagagtaaaaaatttaacacccatagtaggcctaaaagcagccaccaaaaaaaaa

SEQ ID NO: 50589 - DNA, 203 bp, Homo sapiens
ggtagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaa

SEQ ID NO: 50590 - DNA, 401 bp, Homo sapiens
  misc_feature 21, 37, 40: n = A,T,C or G
ggtgtgaggaagataaagacnttccaagtggaagatnctnacataatggtaaagtcacaaaagaactctgtggcactaatattaaaacattaaaggatggtgtcagaagtagcaaaaataaaaactgcccaaagtcttcctaagaggagtgaccctagattttaaagggaaggctaaatctctaatgcgtgagtatgatggtaaacaaggatgctgtacacctaggtaagtgtttatcttggaaatgataaaaagatcgctaaaattctaaggaaaataagatgatgacatatccacactagaaagcttagcctggtagtaatgggcaagatggactagaatgtggtaataatgtggacaggtagactagatggggcaggagtctagtaaaatagatcaaa

SEQ ID NO: 50591 - DNA, 483 bp, Homo sapiens
  misc_feature 32, 54, 331, 402: n = A,T,C or G
gaaatttagctcagagactattgatcttttgnttcattaatatgaacaactatnagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgcctctgagtaatgattgnagttaaatgaagtataagcttgcaactatactatcacatgggcggtaagtaaaaataaataaaccaaattngctgagacaggctaagacaatcttctcatcaaaccaattttctctaagagcaatttcactttcagttttaaggggggacat

SEQ ID NO: 50592 - DNA, 373 bp, Homo sapiens
  misc_feature 36: n = A,T,C or G
cttttccccggttgctagcttgctgtgagtgctctngggtgataccgtgaggtcgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatccttaaaaaaaaaaa

SEQ ID NO: 50593 - DNA, 693 bp, Homo sapiens
tacttaaaaaatatagtcaataggttactaggatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaaggattaattggggagtggtaaggatgaaacaatttggagaagatagaaagtttgaagtgggaaaactggaagacagaaagtacggggaaggccgaagaaaagaatagaggaaggataggggaaattaggaagataaaaacatacttttaggaagaaaaaaggataaattaaaccctgaaaggtagggaagcaggaagaaaaaaaggacaagcttaggaaacaaaaaggcaaggggct

SEQ ID NO: 50594 - DNA, 371 bp, Homo sapiens
  misc_feature 62: n = A,T,C or G
gtttgtttatgggcataaggctacttccttcttttcttcaatatacatataaatcttgctgncatcatatatgagagacagagaaagagatgtgtacacacacacacttacacattcacacattcacactcacagagagatatagcagagttgcatgagtcttagaactaaacaaaacaaaaacctgatacctattatgttgtcccagaaagcgaattaaactggatcttaaaaagacatgtatgcggcgggcgcagtggctcacgcctgtaatcccagcactttgggaggccgaggcaggtggatcacgaggtcaggggttcgagaccagcctgaccaacatggtgaaaccctgtctctactaaaaaaaa

SEQ ID NO: 50595 - DNA, 120 bp, Homo sapiens
  misc_feature 14, 38: n = A,T,C or G
gttttgtttattgngcaagacatatcttcattaagagnttttggaaaactcatcaaattcgatgaatacattttcttcataacccatttggaattattcctaataaaatgataaaatacg

SEQ ID NO: 50596 - DNA, 250 bp, Homo sapiens
gaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 50597 - DNA, 547 bp, Homo sapiens
  misc_feature 48, 208, 436: n = A,T,C or G
gaagatataaacatcattgacacggaggaagatctggagagacagctncaggacaagctaaatgaatcagatgaacagcccaggaaaatgaaggaccaatcagctggttatgggaattcagaagcagattgacaacatgaaaggcaagctccaagagacccaggacagggcaaaacgacaagaggatctcatcatgaaagtggaaaanctggctctcaagaacagatttcaggctgtctggatgagctcaaacaaaaggaagaccgagaaaaggagcaactcagctctttgcaagaggagctagaatcactcctagagaagtaaaaagaactgatatttaatttcagtcttcagactggtcaagcattagaaaattcttggctttattggactgggtattaagaccttgctcttcctagtccttttaatgctgggngtctgtaagttctttcattggttggaaatttggttttcagcaaatttggaatggtttgctaggggggtcatcctataagaagcaggattgtataggcagaaaaatggattg

SEQ ID NO: 50598 - DNA, 358 bp, Homo sapiens
  misc_feature 34: n = A,T,C or G
tctcccagtgacaacatcgcaacaggtttttacntctcttaggtggctctgggaatgggagaggggtaggatgtacaggggtagtttgttttagaaccagccgtattttacatgaagctgtataattaattgtcattatttttgttagcaaagattaaatgtgtcattggaagccatcccttttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaa

SEQ ID NO: 50599 - DNA, 115 bp, Homo sapiens
  misc_feature 19, 36, 63: n = A,T,C or G
atgttacacaaaaaaaaangcaaatggggtttcatnggaatcaccaagtgcttagaacttgcnggcttccccataggcgggaaaggggtctgagctcacaccgagttgtgcttgg

SEQ ID NO: 50600 - DNA, 215 bp, Homo sapiens
  misc_feature 31: n = A,T,C or G
gaagtcctggcacagtttttggaaagccctngcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccca

SEQ ID NO: 50601 - DNA, 130 bp, Homo sapiens
  misc_feature 29: n = A,T,C or G
ggaacccgggagacggaggcagcagtganctgaggacgcgccactgcactccagcctgggtgacagagcgagactccatctcaaaaaaaaaattttctaatttcccatcatctgatcctaccgaaaaaaa

SEQ ID NO: 50602 - DNA, 401 bp, Homo sapiens
  misc_feature 39, 53, 323: n = A,T,C or G
tcaaaatcaacaccgatgagattatgacttcactcaagnctgttaatggacanatagaaagcctcattagtcctgatggttctcgtaaaaaccccgctagaaactgcagagacctgaaattctgccatcctgaactcaagagtggagaatacttgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggttggagagtccatggatggnggttttcaagtttagctacggcaatcctgaacttcctgaagatgtccttgatgtgcagctggaattcttcgacttctc

SEQ ID NO: 50603 - DNA, 603 bp, Homo sapiens
  misc_feature 47: n = A,T,C or G
gttactaacattttaaagaccacacaaggaagcaaaatctttctganggaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagcgatccatggagagccaattattaaaaaatacaccaaaatcattgatggagtgccttgtggaaataactgaaaaagagacacgagaagaacgaatcattacaggtcctgaaataaaatacactaggatttctactggaggtggagaaacagaggaaactctgaagaaattggtacaagaagaggcaccaaggcaccaaattcattgaagggggggatggcatttatttgaagatgaagaaattaaaagactgcttca

SEQ ID NO: 50604 - DNA, 475 bp, Homo sapiens
  misc_feature 106: n = A,T,C or G
agatggatgtggataccccgagcggcaccaacagcggcgcgggcaagaagcgctttgaagtgaaaaagtggaatgcagtagccctctgggcctgggatattgtggntgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctgctcaaaacacgacaggtgtgccattggacaacagagagtgggaatccaaaagtatggcactaggaaaagacttcttccatcaagcttaattgttttgttattcatttaatgactttccctgctggtacctaattacaaattggatggaactgggttttttctgctttggtttttcaggttgctggttctggaagccatattgtatctgggcaaataaagtccagt

SEQ ID NO: 50605 - DNA, 477 bp, Homo sapiens
  misc_feature 34, 45, 46, 306, 388, 399, 414, 452: n = A,T,C or G
atgtgtgacttcaccgaagaccagaccgcagagntcaaggaggcnntccagctgtttgaccgaacagagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgnatcaactatgaagagctcgtccgcatggtgctgaatggctgaggaccttcccagtctccccagagtccgtgcctttccctgngggaattttgnatctaagcctaaagnttccctaggctttcttggctcagcaactttcccatctngctctcttggatgatggttgccggc

SEQ ID NO: 50606 - DNA, 574 bp, Homo sapiens
  misc_feature 52, 116, 405, 415, 479: n = A,T,C or G
gcgaggcataccttagtatacatatgagaactcatacaggagagaaaccacngggagtgcagggaatgcgggaaatcctttagtttcaattcacaactcattgtgcatcagagaantcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgngagaaatccntcagtgggaaattacgccttcttgtacaccagagaatgcaccaagagagaaccatatgaatgcngggagtgggggaaaaagccttcattagggaattctcaactcattgtacatcaaagaactcattcagggagagaaccctatgggggcaatggaatg

SEQ ID NO: 50607 - DNA, 559 bp, Homo sapiens
  misc_feature 33, 185, 411, 469: n = A,T,C or G
ttgaaaacagtctgaatgaatttggtgaaaagngggagttaaactctggagatggagctttctatggcccaaagattgacatacagattaaagatgcgattgggcggtaccaccagtgtgcaaccatccagctggatttccagttgcccatcagatttaatcttacttatgtaagccatgatggngatgataagaaaaggccagtgattgttcatcgagccatcttgggatcagtggaaagaatgattgctatcctcacagaaaactatgggggcaaatggccttttggctgtcccctcgcaggtaatggtagttccagtgggaccaacctgtgatgaatatgcccaaaaggtacgacaacaattccacgatgccaaattcatggcagacattgatctggatccaggctgnacattgaataaaaagatcgaaatgcacagttagcacagtataacttcatttaagtgtnggggaaaaagagaaaatcaagggcctgtaatatccgacaagaaacaataaggtccccggggaccgcaccatttctgaaactatcgggggg

SEQ ID NO: 50608 - DNA, 173 bp, Homo sapiens
gcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggtaaaaaaaaaaa

SEQ ID NO: 50609 - DNA, 240 bp, Homo sapiens
gagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattg

SEQ ID NO: 50610 - DNA, 107 bp, Homo sapiens
  misc_feature 18, 38: n = A,T,C or G
agcattaaaacttgcctnaagctaccagatgtgctttngccaccattggccatactgtgtgtttgtttgtttaatttactttcacaataaacttctgtgtaacaaaa

SEQ ID NO: 50611 - DNA, 259 bp, Homo sapiens
  misc_feature 62, 73, 74, 75: n = A,T,C or G
ggttttagattttttaaagatttaagacagagaaagagcttagtgtgtgcttgtgtgtgtgngtgtgtgtatnnncaatatatattggtgtcttactcagatatatcactaccttgagagaaaggatctgaaagaatagcatacaactaattcaattaccaaaaacaggagaatatcctttattaatcaagtacaacaggaaagcgtaagaaagaaagattttaaaaatcacagaaataatattcaactttacacaaaa

SEQ ID NO: 50612 - DNA, 328 bp, Homo sapiens
  misc_feature 27: n = A,T,C or G
caaccgaaaccaaataatgcaagcacngcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgctgatactggcattttgtagatgtggtttgactatttctgtatgtctccatctattgatgagggcataaaaaaa

SEQ ID NO: 50613 - DNA, 196 bp, Homo sapiens
ctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaaaaaaa

SEQ ID NO: 50614 - DNA, 474 bp, Homo sapiens
  misc_feature 17: n = A,T,C or G
gaacacaaaacagtaanagaatattgcactgatagatactaaattattatggttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggaaatgctttgtgtttttatgtaaaatattttctaaacaaaaaatgttaaaagtacatgtcctctgtagtaaactgatatctatatatatgaatcattcaagcctaaagctagtaataaactg

SEQ ID NO: 50615 - DNA, 101 bp, Homo sapiens
  misc_feature 29, 74: n = A,T,C or G
gtaatggacccagatggaacttgtaacgngggccccacatgatagaactaaattcagatatcattaaataaacncttgtcactaaaaaaaaaaaaaaaaaa

SEQ ID NO: 50616 - DNA, 230 bp, Homo sapiens
  misc_feature 18: n = A,T,C or G
atgcgataggaggttacngggaatcacagattgttgaaggtaaaaagagacttcaaatataatccaggtcaattattcttagtagggggagttatgtatcaattagagttctttggttgttagcaacagaatccaacttgactatcttaagcaaaacaggaatttattgagaggctattcaacttggagaactaaaggataagctgaataactaacctccaaaaaaaaaa

SEQ ID NO: 50617 - DNA, 222 bp, Homo sapiens
  misc_feature 38, 147, 148: n = A,T,C or G
agttttgtgggtacttcaccctcttctgccctcatttnatgtgacagccattgtgagactgatacacaaactgtcacttggttaatttaagcacttctgttttcgtgaatttgcttgtttgtttcttcatgcctttacttactttgnnccatgctactgattggcacgtggccccacaatggcacaataaagcccctttgtgaaactgttctttaaatgaaa

SEQ ID NO: 50618 - DNA, 469 bp, Homo sapiens
  misc_feature 347: n = A,T,C or G
ccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacataagccaaaagtatgtgccgttgcacaagactgtgtttatgactcaaccgttggttggaaaagactttgtttcatgtgtatttgaaagatggaattattttttccttcctgacctaaccttagaactggattaagggtgggatctttgaaaagctgacatttgctgctatcattccaacactaaattcttaagtagntgcccaaggccaagctcaagtttatccttcggagagacaaggatatgcatgattctaaccaggctatatgtaaaaaaaaaatggaaaatgcaatacattttttattatacaaactaaaaaaa

SEQ ID NO: 50619 - DNA, 103 bp, Homo sapiens
  misc_feature 7: n = A,T,C or G
tgctccnggccaggcggtctgcgaaatcatatggctgtagcattcgtgctatccctgggggttgcagctttgtataagtttcgtggggcggatcaaagaaaga

SEQ ID NO: 50620 - DNA, 172 bp, Homo sapiens
ctataggactggctcgagaatactaaaacacttatcttacagcaagtgaacaggggctacctgccacatcccctccacagatgcactttaaaaagccactcatgctttggcttaaactgtaattaatttattttatgtacaataaatcgcatttgaagaagagaaaaaaaaa

SEQ ID NO: 50621 - DNA, 340 bp, Homo sapiens
aggaacggcatcgaggtcaacgtcagcgagctcggattggtcacacagggcggaaaggtcatctggggtaaatacgcccaggtgacgaataacccagaaaatgatggctgtattaatgccgtgttgctggtttaacgggagaccctgaaaggtttattattgaactgtgcccccgagtacagctggaaagtgcttttctctggaaaacccccatcatcatcgtcattatccagggaatattgaaattgcaaaagaagatttgaagacctctgatggagttttgtttcacctttgcattcggattcacgtggatcagaaataaagtgctgtttattttgaa

SEQ ID NO: 50622 - DNA, 607 bp, Homo sapiens
  misc_feature 26, 66, 78: n = A,T,C or G
tcctgaggtgacagcgcctgcaactngaaatttcagcagcgtttagaagatggacaagagaaagcncgggcgacgggnatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaacccaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgcaaagccttaatttatctgaaaggatacccagagttatattgacgaatggcctgggaacggagttaggaagaaaatacataaggaccccacctgtactgagggaagtttgagtgatacagacaacttgcaatcagagcaactttcttcat

SEQ ID NO: 50623 - DNA, 328 bp, Homo sapiens
  misc_feature 32, 50: n = A,T,C or G
taatttgagtgtggaaataactgaggagtgtngataatggggtttagttnggggcttcatgggaaactccctgtaaactaaaagctcagggttatgtctatgttcattctatagaagaaatgcaaactatcactgtattttaatatttgttattctctcatgaatagaaatttgtgtaggacgcaaacaaaatacttttacccacttaaaaagagaatataacattttatgtcactataatcttttgttttttaagttagtgtatattttgttgtgattatctttttgtggtgtgaataaatcttttatcttgaatgtaataagaaaa

SEQ ID NO: 50624 - DNA, 120 bp, Homo sapiens
  misc_feature 28, 32, 67: n = A,T,C or G
gaaagggaagaacaagctagtgcccagncttntggacatcaccaaggagtgtgtgatgcgagtggangagaagaccaaggaagtgatccaggagtggaacctcaccaacatcaaaaaaaa

SEQ ID NO: 50625 - DNA, 409 bp, Homo sapiens
  misc_feature 54: n = A,T,C or G
gtcagaactaaggaatgaattacagcggaaagatgcactagtccagaagcactngacaaagctgaggcattggcaagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttgtataaaaaaaaaaaa

SEQ ID NO: 50626 - DNA, 431 bp, Homo sapiens
atgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagcttgctgggtgaagatgcatgaataggtccaaccagctgtacatttggaaaaataaaactttattaaaccaaa

SEQ ID NO: 50627 - DNA, 208 bp, Homo sapiens
gggcacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggttaaaaaaaaaa

SEQ ID NO: 50628 - DNA, 442 bp, Homo sapiens
  misc_feature 51, 66, 144, 181, 310, 344, 420: n = A,T,C or G
acaggaaagagcctacaggaatggatcctgatgatatttggcagctgtccnccagtcttaaaaggnttgatgacaaatacaccttgaagctgaccttcatcagtgggagaacagagcagcagcgggaagccgagttcacaaagnccattgctaagttttttgaccacagtgggacactggncatggatgcatatgagcctgaaatatccaggctccatgacagtcttgccatagaaagaaaaataaagtagccaattctaaaagtagccctctttctcctggatcttgctgaattagtggcttggggggngggggagataaaaaagaacttaaaatgggaaagnaagaaatggtaaaaagccctgttttgcctgaaattttagtctattctgggtaaataaggattttctgacacaaggnatgagaaggtggagctctgaag

SEQ ID NO: 50629 - DNA, 284 bp, Homo sapiens
aatgagacatagcacaccccaaaggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggctcatcattcctgcaaagcttgctttggggagttggataatgtgaaaattttaagtacctaggggagaaagagccatgtaaatatctgtaataaacttgtagcatatgt

SEQ ID NO: 50630 - DNA, 300 bp, Homo sapiens
  misc_feature 274: n = A,T,C or G
tttcaatgtgtcatccctggtgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacggaagcactcttaattaatatctgnatcctggaacaatattttatggtatg

SEQ ID NO: 50631 - DNA, 163 bp, Homo sapiens
  misc_feature 68, 75, 76, 95: n = A,T,C or G
gaccagcctggtcaacatagcgaaaccccatctctataagaaataaaaaatttgactgggcatggtgnctcacgnntgtcgtcccagcactttgngctggcaaggcgggcaggagcacgaggtcaggagatggagaccatcctggctaacacagtgaaaccct

SEQ ID NO: 50632 - DNA, 168 bp, Homo sapiens
  misc_feature 39, 75, 89, 93, 135: n = A,T,C or G
ggaacagaatctgacagtgatgaatcagtaccagggctngaagaacaggattccacccaggcaaccacacaacangcccagctggcggnagcngctgaaatcgatgaagaaccagtcagtaaagcaaaacagagncggagtgaaaagaaggcacggaaggctatgtcc

SEQ ID NO: 50633 - DNA, 369 bp, Homo sapiens
gatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagagctttaagtagtttaaaatgggcttttgcttttctaggtcattaacgttttttatttagtttctttagccaatagtggctgagtttcggcacttgattttcaatattttatagtaagaaatgacaaactgctttgtttcatttcataaacaaactctgcatttagataactattaaaggttgtta

SEQ ID NO: 50634 - DNA, 219 bp, Homo sapiens
ggatattgggttgtttttgtcatagatttcattaataaatttatttctgccctcaactatatatacaactgagtaagccatttaagaattctgactccttggctgggcatggtggctcatgcctgtaatcccagtactttgggaggccaaggcagccagatcacttgaggtcaggagtttgagaccaacctggccaacatggtgaaactctgtctctac

SEQ ID NO: 50635 - DNA, 501 bp, Homo sapiens
aacatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagattaagaaaaaagttacaacataatctagtttacagaaaaacttg

SEQ ID NO: 50636 - DNA, 394 bp, Homo sapiens
gaggctcttcaggttctcctcttgtcattcggcagcccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcaggacatgaatacatttcccaccttcaaatttgaagatcccaaatttgaagtcatcgaaaaaccccaggcctgaagaaataaagtaaaattaatctggtaatttgcacggattagttgacaactagttagaagtttcagaataaacatgc

SEQ ID NO: 50637 - DNA, 123 bp, Homo sapiens
  misc_feature 34: n = A,T,C or G
atgaaggaggcaacctcatggggcccagccattngtcttgtaaagtcttaaactaccataggaaatccctgtaggatgttctattgtgtaagagttccatttaaaatacattggcaatatcct

SEQ ID NO: 50638 - DNA, 211 bp, Homo sapiens
  misc_feature 80, 135: n = A,T,C or G
gtgggctgttacttgctttgagttgggaagcggtttgcatttacgcctgtaaatgtattcattcttaatttatgtaaggntttttttgtacgcaattctcgattctttgaagagatgacaacaaattttggtttnctactgttatgtgagacattaaggccccagcaacacgtcattgtgtaaggaaaaataaaaagtgctgccgtaaccg

SEQ ID NO: 50639 - DNA, 296 bp, Homo sapiens
  misc_feature 113, 114: n = A,T,C or G
cccccttggctctgatcactttaacttcaagcttatgtaacgactgttataaaactgcatatttaaattatttgaattatatgatataattgttcagctatctgggcagctgnnaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcagggttctagcctctacaacctacttca

SEQ ID NO: 50640 - DNA, 428 bp, Homo sapiens
aggataatataaaaacaattgctaaaatatgctaatatttgtgcatgccattttattttctattttagaaaacatagtctcagaaatcacattcatctcattggctttagtgctggcttgcatgctatgtattcttcttttgggcccagacaaattttcttttttaaaaattgttaatacacatgcctgtaactgtaaggcttgttcttctctcaggagaagcctatttcagaaataattatctttgtattggagtcaaacaaacaatccatcatgaaactgaaatatcattggaggttcaagctcatagcaccgaataataaatatatctgtattttcttatcattggtgagataagatgcatcataaaaactggaaaaagttatcaaagtaaaagaacttggaagcggacattaataaagataagc

SEQ ID NO: 50641 - DNA, 159 bp, Homo sapiens
  misc_feature 16, 44, 50: n = A,T,C or G
taacccacataggttngctggcacttgcaaaattgttcatgggnctatgnagcaaatgattctctgccttgacaatcatgtatacatatcaagatttctatcataatgataatgagattgatgacttcctgttttcctccaataaagacaattaatcac

SEQ ID NO: 50642 - DNA, 332 bp, Homo sapiens
  misc_feature 141: n = A,T,C or G
agcatacgtatcaaggacagtaactaccatggctcccgaagttttgccaaaacctcggatgcgtggccttctgccaggcgtctcgaaatcatatggctgtagcattcgtgctatccctgggggttgcagctttgtataagnttcgtgtggctgatcaaagaaagaaggcatacgcagatttctacagaaactacgatgtcatgaaagattttgaggagatgaggaagctggtatctttcagagtgtaaagtaatcttggaatataaagaatttcttcaggttgaattacctagaagtttgcactgacttgtgttcctgactatgacacatga

SEQ ID NO: 50643 - DNA, 416 bp, Homo sapiens
  misc_feature 45, 50, 59: n = A,T,C or G
actgcgcagaccagacttcgctcgtactcgtgcgcctcggtttgnttttnctccgcaancatgtctgacaaacccgatatggctgagatcgagaaattcgataagtcgaaactgaagaagacagagacgcaagagaaaaatccactgccttccaaagaaacgattgaacaggagaagcaagcaggcgagtcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgt

SEQ ID NO: 50644 - DNA, 125 bp, Homo sapiens
  misc_feature 38, 42, 55: n = A,T,C or G
gtggtggctcacatctgtaatcccagcacttgaaaatnactngaagttgggaggnggaggttgcagtgagctcggatcgtgccactgcactccagcttgggtaacagagcaagagtccctctcat

SEQ ID NO: 50645 - DNA, 232 bp, Homo sapiens
  misc_feature 11, 44, 107, 153, 156: n = A,T,C or G
attcatttctntaacagcagtaatattaataattttcatgattngagaagccttcgcttcgaagcgaaaagtcctaatagtagaagaaccctccataaacctggagngactatatggatgccccccaccctaccacacattcgaagaacccgnatncataaaatctagacaaaaaaggaaggaatcgaaccccccaaagctggtttcaagccaaccccatggcccgcatgac

SEQ ID NO: 50646 - DNA, 212 bp, Homo sapiens
  misc_feature 93, 158: n = A,T,C or G
gcccgcaaaggacctttcctttaggtcatattcctcagaaagtcttcaatcttcccttgtttttgtttgtttgtttttcttaaagaatatttncaaagcttaaatttgtatattaatttaggactatttagaagtataggctgcggttggcggcagcngtatattctgaaatgtctcatagatatatatttttgaataaagatggtgttgtt

SEQ ID NO: 50647 - DNA, 416 bp, Homo sapiens
  misc_feature 4, 10, 277, 359: n = A,T,C or G
aaanaccagntaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggaactttaaatctttatcatagactctgtacatatgttcaaattagctgcttgcctgatgtgtgtatcatcggngggatgacagaacaaacatatttatgatcatgaataatgtgctttgtaaaaagattcaagttattagggaagcatactctgnttttaatcatgtataatattccatgatactttatagacaattctgctcaggaaagct

SEQ ID NO: 50648 - DNA, 270 bp, Homo sapiens
aaaacgagctaacgtactactgctgcaagaaggacctgtgtaactttaacgaacagcttgaaaatggtgggacatccttatcagagaaaacagttcttctgctggtgactccatttctggcagcagctggagccttcatccctaagtcaacaccaggagagcttctcccaaactccccgttcctgcgtagtccgctttctcttgctgccacattctaaaggcttgatattttccaaatggatcctgttgggaaagaataaaattagcttg

SEQ ID NO: 50649 - DNA, 326 bp, Homo sapiens
  misc_feature 296: n = A,T,C or G
accctatcgacgcagcggtccccacttggttgaagttgacatctgacgacgtgaaggagcagatttacaaactggccaagaagggcttactccttcacagatcggtgtaatcctgagagattcacatggtgttgcacaagtaccgttttgtgacaggcaataaaattttaagaattcttaagtctaagggacttgctcctgatcttcctgaagatctctaccatttaattaagaaagcaggttgctgttcgaaagcatcttgagaggacagaaaggataaggatgctaaattccgnctgattctaatagagagccggattcacccg

SEQ ID NO: 50650 - DNA, 294 bp, Homo sapiens
attaataatagcagagaactaaagaatatcatttaaagctgagaaatatatagaaatgtaaacacatttaattgtacaaagataaacatttaaaaagataatactagttatgaaaattgaatggtagaggaaagggagggcaaggagggggaagaggaaataattttaatattgttctttttaggggattaagagctacagtctaaagaaccagacaattaagggcatacaataataaaggtaataattaggacccaaatcaaaatttcctaaatattataagaaatatacacc

SEQ ID NO: 50651 - DNA, 513 bp, Homo sapiens
tcagagattgaagatcaacttaatgaaataaagcatgaagacaagattagagaaaaaagaatgaaatggaatgaacatagcctccaagaaatatgggactatgtgaaagaccaaacctacgtttgattggtgtacctgaaagtggcggggagaatagaacctaattgaaaaacacatttcaggatattatccaggagaacttccccaacctagcaaggcagaccaacattcatattcaggaaatacagaaaacaccacaaagatactgctctagaagagcaaccccaagacacgtaatcgtcagattcatcaaggttgaaatgaaggaaaaaatggtaagggcagccagagagaaaagtagggttacccacaaagggaagcccatcagactaatagcatatctctctgcagaaaccctacaagccagaagagagtggggccaatattcaacactcttaaagaaaagaattttcaacccagaatttcatatccagccaaactaagctttataag

SEQ ID NO: 50652 - DNA, 100 bp, Homo sapiens
  misc_feature 3, 19: n = A,T,C or G
aantcaaatgctttttgtnttatttttttaccaattgcaatttcaaaatgtctcaatggtgctataataaataaacttcaacactctttatgataaaaag

SEQ ID NO: 50653 - DNA, 326 bp, Homo sapiens
  misc_feature 51, 59, 97, 295: n = A,T,C or G
gacaaattatgggacgtttgtaggaacctgagtatttttctttttaccagntttttagnttgagctcttaggtttattggagctagcaataattggntctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtgggnacgcctgtaatcccagtgacttgggaggctg

SEQ ID NO: 50654 - DNA, 423 bp, Homo sapiens
  misc_feature 52: n = A,T,C or G
cagcatctagctccatgtgcccaggccttacttatctgtaaagcaggcaggngtacaaccttgaaacatctagcaaacctagtatctaagttgtatgatttacaccacctttttgcattttgatgacacttgcattttaccaataatccttgactatttttatttcttaaagtcatgtgaactaaaaagtatttgatttaagacacttatttttctttaagccaatcaattagagctctttttatagacattgcacacaacacatatacagcaacgtgaacagacaaaagattcaacacttgtaagattttttatttgccagtttcttaattggattactgctcaggggtggagcccttggatgaacagggtcagggtagcatgcattaagactggtaagacaaaaaaatggagaaaagtaat

SEQ ID NO: 50655 - DNA, 443 bp, Homo sapiens
gcctgcagtgctacaaccgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagctggagccttcatccctaagtcaacaccaggagagcttctcccaaactccccgttcctgcgagtccgctttctcttgctgcacattctaaaggcttgatatttcccaaatggatcctgtgggaaagaataaaattaggcttgagcaacc

SEQ ID NO: 50656 - DNA, 265 bp, Homo sapiens
ttgagatcgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccaaaaaaaaaaaaa

SEQ ID NO: 50657 - DNA, 326 bp, Homo sapiens
atgagggcagaaacttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgggttttgcttttatccactggcatttttagctccttgaagacatatcatgtgtgagataacttccttcacatctcccatggccctagcaaaatgctaggcctgtagtagtcaagggctcaataaatatttggtt

SEQ ID NO: 50658 - DNA, 386 bp, Homo sapiens
  misc_feature 16, 17, 25, 193, 317: n = A,T,C or G
gagatgataagagaannctcgaacngcatggattgtgccaatctgtcctgagtgttcatgctttgtaccaaatttaatgaacgcgtgttctgtaatcaaactgcaaatattgtcataaccaacatccaaaatgacggctgctatatataagtgtttgcatatggaatttaatcgtaagccatgatcataatgntaactaaataactttatgtggcactgctagtaagggactatggaaaggtttggatttctccaaatctgggagaattttcaaaataagaaaataacctttatatgatactatgactaggctgggnatttcttttcagggatttttctaccttcagggttggatgtaggttaagttactattaccatagccaacc

SEQ ID NO: 50659 - DNA, 373 bp, Homo sapiens
cccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacgcaattattattctaacaatgattattagctcattcacttattttgataactaatgatcacagctattatactactttctcg

SEQ ID NO: 50660 - DNA, 296 bp, Homo sapiens
gtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgcccagtttgtttctccatttactggatgcatttatggaaggcacattacaggtctttgtgggaagaaacagaaagaaatcacaaaagcaattaagagagctcaaataatgggg

SEQ ID NO: 50661 - DNA, 370 bp, Homo sapiens
aacatggatgctgccaattttgagcagtttttgcaagaaaggatcaaagtgaacggaaaagctgggaaccttggtggaggggtggtgccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttaccgaattacgttacttccagattaaccaggacgaagaagaggaggaagacgaggattaaatttcatttatctggaaaattttgtatgagttcttgaataaaacttgggaactaaaaaaaaaaaaaaaaaaaaaaaaaa

SEQ ID NO: 50662 - DNA, 350 bp, Homo sapiens
acagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttgcagttgacaagaagttaatttgctttagtaaaaatccctcattccagcctttctatataaatagctctttcttgctgtttaatgggggcacactatagcctcacaaacctgtattccag

SEQ ID NO: 50663 - DNA, 328 bp, Homo sapiens
  misc_feature 40: n = A,T,C or G
cgagtggagagagcgagctgagtggttgtgtggtcgcgtntcggaaaccggtagcgcttgcagcatgctgaccaactgactgaagacagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgcaatgatggcaagaaaaatgaaagacacagacagtgaagaagaaattagagaagcc

SEQ ID NO: 50664 - DNA, 364 bp, Homo sapiens
  misc_feature 15, 33, 45, 49, 112, 128: n = A,T,C or G
agggagccagccatntatgcttgctaaagaaantgtctacctttncttnctcacctgttccatttatgtaaagttgagattagagggaaagcattttctatatcaattgtgnttaaacctttcaaganggttatttagctagcttagtgtgtgaactaaatttttttttaaacaaggcaaggctaatgctgttttgagattctgaaattaatgaaaatacttatttcagaaatgcatttaatgctttttttcttgtgacagttacgcaaatcagcttgaatccatatgtccctgagttatttttatcataaagccacaaatgtattataacaagcaaattgtaatatatataatcctgaactcg

SEQ ID NO: 50665 - DNA, 456 bp, Homo sapiens
  misc_feature 27, 32, 40, 70, 323, 358: n = A,T,C or G
cctggcattgattggcggtaccagtgnccagnactatgantatgattttcccctatcaatttatgggcantcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgccatattgatgaaaaggcctttgagaatgtaactgatctgcagtggctcattctagatcacaaccttctagaaaactccaagataaaagggagagtttctctaaattgaaacanctggagagctgcatataaaccacaacaacctgacnggtctgtgggcccacttcccaaatctctggagggacttgcagcttactcataacaagaacacaaaggtgggctctttttgaaggattggtaaacctga

SEQ ID NO: 50666 - DNA, 375 bp, Homo sapiens
  misc_feature 338: n = A,T,C or G
aatgggtctcttgttgaaatccgaaatttcttgggtgaaaaatacatccgcagggttcgggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaaagagttacctgctacagaaagaagatgccagatgacacttaagacctacttgtgatatttaaatgatgccantaaaaagaccctattgttttggaccttctttcttatt

SEQ ID NO: 50667 - DNA, 129 bp, Homo sapiens
catacttttagaagaaaaaagataaatttaaaccggaaaactggaagacagaagtacgggaaggcggagaaaagaatagagaagatagggaaattagaagataaaaacatacttttagaggaaaaaaaa

SEQ ID NO: 50668 - DNA, 309 bp, Homo sapiens
  misc_feature 11, 25, 271: n = A,T,C or G
atgtacagggnaaggtggatttagnaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctgggacagtacctgantgtatttttttttttaaataaaagcacaagaccttttg

SEQ ID NO: 50669 - DNA, 437 bp, Homo sapiens
  misc_feature 53, 261, 325, 420: n = A,T,C or G
aattctcacaatcgtgtcgtcacatagtgcaaaaaacaaaattcttgtaaagnccccaggagtttatgcttgggtgaaagttttagcctgagtattttcttcctctaaaaaaggtgggaaatgagacattgaggaattaacatataaatgtctgctatgggtttaagagaactggcgtattttggaatgcttcttacactaacactgtctcattgtaaaatataaaaccccttactctaactacatttttattcctctggnagtgtggtatccaggcaacatatcacttctgctatgtaattctaagaattctcatttctagagnacctgagccaaacaaatacacaacgggaagctgcagctgtatcatcactagcaattttgctcatcattatttactacctttgaacctaagggttnctgctatgcttttgaaa

SEQ ID NO: 50670 - DNA, 270 bp, Homo sapiens
  misc_feature 27: n = A,T,C or G
tcctttaactgagacatcatcttagtncaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgaaaaaaaaa

SEQ ID NO: 50671 - DNA, 372 bp, Homo sapiens
  misc_feature 28, 45, 63, 81, 90, 108, 113, 258, 274, 324: n = A,T,C or G
cataccttgatacttgtttggggaaagnggaattactaggtcagntccactagcaactgctgnagtggaaatcctaggagnggaactgcngggtcatgtggtaactcntatgnttacctaaaccttttgaaaaactgcccgattgttttccccagtggctgcatgactctacattcccatcagtagtgtatgagggttccacttactccacatcctcagccacacttgttactgtctttgtgaaatggtcatcattgngaatttgatttgcatntcctgggggtaatgatggtaagcatctttcatgtgcttgctggcatttgnatatcctctttggaagaatatctgtcaaatccttctgctgtttcaaat

SEQ ID NO: 50672 - DNA, 198 bp, Homo sapiens
  misc_feature 63: n = A,T,C or G
tataaaagctgcatatgcctacaaagctctgaattcaggtcccagttgctgtcacaaaggagngagtgaaactcccaccctacccccttttttatataataaaagtgccttagcatgtgttgcagctgtcaccactacagtaagctggtttacagatgttttccactgagcatcacaataaagagaaccatgtgccct

SEQ ID NO: 50673 - DNA, 447 bp, Homo sapiens
  misc_feature 56, 327, 362: n = A,T,C or G
taggctgttggttcaaacttttgggagcacggactgtcagttctctgggaagtggncagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgtctttcctcacatttggatgattgcataaggtttttagcatgttcctccttttcttcaccctccccttttttcttctattaatcaagagaaacttcaaaggtaatggganggcggatctcacaggctgagaactcgtcaccttcnagcatttcatgaaaaagctgcttcttattaatcatacaactcttaccatgatgtgaagagtttcacaaatccttcaaaataaaaa

SEQ ID NO: 50674 - DNA, 558 bp, Homo sapiens
  misc_feature 382, 442, 485, 551: n = A,T,C or G
gcaactgggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaaatgaacatgatgaacaggtcctacaacgtgactttaaaaagacagcagaaagcaaaaatgtcccattggaacgagaagccactagnaaaatgccaaaataactgtcctgtgaaaccctgtacctcaatatcttggaagatgagcanctttaaatagtgctgcccataaggaggcaccctcctactgtgnttcaactcaacagcctaaccctttgccggttcgtttacctgaaatggaacccttagtgcctagggncaaaaat

SEQ ID NO: 50675 - DNA, 143 bp, Homo sapiens
  misc_feature 15: n = A,T,C or G
tagaagataaaaacntacttttagaagaaaaaagataaatttaaaccggaaaactggaagacagaagtacgggaaggcggagaaaagaatagagaagatagggaaattagaagataaaaacatacttttagaagaaaaaaaaa

SEQ ID NO: 50676 - DNA, 269 bp, Homo sapiens
cttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaa

SEQ ID NO: 50677 - DNA, 341 bp, Homo sapiens
  misc_feature 13, 41, 42, 105: n = A,T,C or G
cagttcctctccnaattgcaatgagaaaaaaaagcttaatnnttacattatacttaattttctaaaaccatgtaactccattgaacacatttttcaacttaaggnctgcatagcagacttttaataaccttgggatttatctggtagaacaatatgtgttctacatttttttcataattatatattgtgtatgttaaaactattttccagttgttttgtctgtaaaactgtctttatcaatatgcttaatggtctttgtacaattttgaaagtttctacctgtatataatggatgttaaccagtatcaataaatcacttcgtataatccaaaaaaaaaaaa

SEQ ID NO: 50678 - DNA, 406 bp, Homo sapiens
  misc_feature 246, 279, 360: n = A,T,C or G
tcacagaagtattccagggtttatgtgtcagggtggtgacttcacacgccataatggcactggtggcaagtccatctatggggagaaatttgaagatgagaacttcatcctaaagcatacgggtcctggcatcttgtccaaggcaaatgctggacccaatacaaatggttcccagtttttcatctgcactgccaagactgagtggttggatggcaagcatgtggtgtttggcaaagtgaaagaagncatgaatattgtggaggccatggagcgctttgngtccaggaatggcaagaccagcaagaagatcaccattgctgactgtggacaactcgaataaagtttgacttgggttttatnttaaccaccagatcattccttctgtagctcaaggagagcaccccct

SEQ ID NO: 50679 - DNA, 365 bp, Homo sapiens
  misc_feature 20, 21: n = A,T,C or G
aaggacagaaactaccatgnnttccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtggctaagaaatagttcctcttgataaataaacaa

SEQ ID NO: 50680 - DNA, 315 bp, Homo sapiens
  misc_feature 37, 228: n = A,T,C or G
ttaccccaaatcatgcagtattgagttatgacttgtnaaagctattcccataccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggntatttgcctgctcactttatgtttacatctcccacattcataccaatatacgtcaggtttgcttaaccattgatttttttttttttt

SEQ ID NO: 50681 - DNA, 429 bp, Homo sapiens
  misc_feature 18, 400: n = A,T,C or G
ggctgaaggaaatagcanattcacctacacagttctggaggatggttgcacgaaacacactggggaatggagcaaaacagtctttggatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgcaaccagtgcaagtgaccgcaaaattccagttatttatttccaaaatgttgggaaacagtataatttgacaaagaaaaatgatacttctctttttttgctggtccaccaaatcaattcaaatgctttttggntaatttttaccaattccaatttcaaaatg

SEQ ID NO: 50682 - DNA, 521 bp, Homo sapiens
  misc_feature 338, 400, 427, 458: n = A,T,C or G
cacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttaggtcacaacaaaatcacacatgtgatcnttgcaagggcataaatatatcattcatacccccattaaattttggtagaaaaattaccacantaaatatatgaggtaagtagattggantgctgaaaatggggggtgggcatattaagcnaaatattcttaattgggggactcgattcttttttactacatatttcccaaggtatcttaagaa

SEQ ID NO: 50683 - DNA, 340 bp, Homo sapiens
  misc_feature 13: n = A,T,C or G
cagttcctctccnaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgctttatcaatatgcttaatggttctttgtacaattttgaaagtttctacctgtatataatggatgttaaccagtatcaataaatcacttcgtataatccaaaaaaaaaaa

SEQ ID NO: 50684 - DNA, 406 bp, Homo sapiens
  misc_feature 15, 161, 205, 232, 274: n = A,T,C or G
tgagacataagcacntaataaatgcagttgaatggataatgattagtgttatttatggattagaaaaagcatgtttctatttaagtaagctgtaaaaagtattattgaatatttactgtaaatatatgttcacataaaaaaataacttggagggtctttgngtccctggcatattatcatcttcatggaaagaatccactgtggnttctgtagagtgattggaaaaatggantattttgaggattgaagaaagtgttctttctgcgttgcactntgttcaacagtaaaactttattctcagggtcctactctgcattgttacatttttgacagtttttttaatcacctacaatctgtaaaggaatgtatatattcttttcagcatctcaagtttgaaaagacatgc

SEQ ID NO: 50685 - DNA, 318 bp, Homo sapiens
ccacagtcgcataccaccatgcccgactaatttttgtatttttttgtagagatggttttgctatgttgcccaggcttggtctcaaactcctgggctcaagcaattagcctgcctcagcctcctaaagtgctgggactattggtgtgagccatcacatgtggccaggagaggggaattttaaaatatttatatactctaaattagtttgttgcaaaataccattctaattaatgcttttatgtcattctcatgaaactaatctgaaagagtaaacttagttttctatttttagatattgtttcaacataccaaattcca

SEQ ID NO: 50686 - DNA, 239 bp, Homo sapiens
  misc_feature 16: n = A,T,C or G
atctgtgcttcagggngcatcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaaaaaaaaaaaa

SEQ ID NO: 50687 - DNA, 383 bp, Homo sapiens
gatatcaactgcttgtaaaggtgctcctcttttttcttgcattgctggcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgcacactagcatagagaatgtgttgaaatttaactttgtaagcttgtatgtggttggtgatcttttttttccttacagaccccataataaaatatcattttaaaaaaaaaaa

SEQ ID NO: 50688 - DNA, 344 bp, Homo sapiens
gccgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacc

SEQ ID NO: 50689 - DNA, 394 bp, Homo sapiens
  misc_feature 357: n = A,T,C or G
ctggtttcttcaagctcttctggcagtgattctgacagtgaggttgacaaaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagacaatggagccagctgaaggaacagattctgacattgatgatgcagtaagaaaactgtnaaattcgagccatataaataaacctgactgtctaggt

SEQ ID NO: 50690 - DNA, 439 bp, Homo sapiens
  misc_feature 16, 25, 31, 378: n = A,T,C or G
caaatgaagcgacacnaagatttgntttggnatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggggattattttttatactgnatgtgccaaagctttactactgtggaaagacaactgttttaataaaagattacattccaca

SEQ ID NO: 50691 - DNA, 315 bp, Homo sapiens
  misc_feature 188, 208, 268, 290: n = A,T,C or G
tacagcctctaacaaaactaggctgtcccgaacccctggtaatagaattgtttacctttataccaagaaggttgggagagcaccaaaatctgcatgtggtgtgtgcccaggcagacttcgaggggttcgtgctgtaagacctaaagttcttatgagattgtccaaaacaaagaaacatgtcagcaggncctatggtggttccatgtgngctaaatgtgttccgtgacaggatcaagcgtgctttccttatcgaggagcagaaaatcgntgtgaaagtgttgaaggcacangcacagagtcagaaagcaaaaaaaa

SEQ ID NO: 50692 - DNA, 162 bp, Homo sapiens
ccccttcgttagtcgtatatggcctaagacagcaatgcaagaagccaatgatacaaacaaaggcatagtaaactttaagggtgcagacatgaatggattaccattcaaaaggccagcagatatctgtgatgaaaagaaagactactgactttttcctaaagg

SEQ ID NO: 50693 - DNA, 452 bp, Homo sapiens
  misc_feature 231, 393: n = A,T,C or G
gctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgntgactttaaacagacataagtatccccttaacctgtacctactttttggatttacgctgttggaagctctgactgtggcaggtggttgtactttctatgatggatatattattctgcaagctttcatactgactactacaggaattttttgggtttgactgngtatactctacaatctaagaaggattcaagcaaattggagcaggctggttgctcttttg

SEQ ID NO: 50694 - DNA, 386 bp, Homo sapiens
  misc_feature 20, 39: n = A,T,C or G
ggaattcttttttgacagcngtttgcatctgtgtacatnttccttagcagtgtaggttgcttttctgagtcttgcaaatcatttttactcagaaaatttacaaagaggaatctgaggtttggaagagaaaagggaaggaaagtggcaaaatggaagtgaagtttttaagtgaatcctgggaggaggcagaggaagctaacacccacagagagagctgagggtgatagccttgtatctagagcaacgcccaaacagcagtgcaaatcgatgattactgagggcatccttgaggcattagtgggaccgaagaggtggatgttacccacttccagcctaaaattaaaaggacattgaatatttgggtgcagtttagatgtagaaaaaaa

SEQ ID NO: 50695 - DNA, 337 bp, Homo sapiens
caacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgcattcaactcggaaactataagtaattctcaagaaagccctcatttttataacctggcaaaatcttgttaatgtcattgctaaaaaataaataaaagctagattcacgttcccaaa

SEQ ID NO: 50696 - DNA, 428 bp, Homo sapiens
  misc_feature 308: n = A,T,C or G
aataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagntagctcatttgagataaagtcaaatgccaaacactagctccgtattaatccccatcattactggtaaagcctcatttgaatgtgtgaattcaatacaggctatgtaaaattttactaatg

SEQ ID NO: 50697 - DNA, 342 bp, Homo sapiens
  misc_feature 22, 45: n = A,T,C or G
taaaatactaattatgtaaggntcattagacaaatgtcttgaagnagacatgggatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagaaaaaaaaa

SEQ ID NO: 50698 - DNA, 102 bp, Homo sapiens
aaacggccgaagtgtgcctcttttaggaatctctttggaattgggagcaccgatgactctgagtttgagctattaaagtacttcttacacattgtaaaaaaa

SEQ ID NO: 50699 - DNA, 423 bp, Homo sapiens
  misc_feature 355: n = A,T,C or G
gaagaattacttaggtatcaatgtacttaggaattctatctgggtgaaattggtccacattgtaatatacaaccatgcccagctccctttttgtaaatttattgtccaatcaaatatctacttttgtgaagtacttgtttaaatttagatttattttataacaggttgtttgtcttttcattaataatttgtggaaatattatatatattctagatacatgtaccaggaaattttaacacagatttctaaataacttctgggttaaaaaggagatcttactgagattacaaacaatttgggactaaatgaaaatgtgagcacagcacttaaaaaaaaactacactcagagggtgnatccaaattatattcagaggacattttacagctttaaacgtcctaatttgacaatgagaaacggttat

SEQ ID NO: 50700 - DNA, 261 bp, Homo sapiens
  misc_feature 200: n = A,T,C or G
aacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggngattattttttatactgtatgtgccaaagctttactactgtggaaagacaactgttttaat

SEQ ID NO: 50701 - DNA, 322 bp, Homo sapiens
  misc_feature 262, 276: n = A,T,C or G
aattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgggaaatcaaagaactgatgcactatatagaacgaatttggggnttttaaagaaatantaaaagttaggtactgtaagtgtcttaaaacctgtaaacttcattc

SEQ ID NO: 50702 - DNA, 313 bp, Homo sapiens
  misc_feature 37: n = A,T,C or G
acataacctcagtatgaccatggaaatctaatggggnatcagcagtggtttctgattctatcacactgagagtaggtagaagtagaatcctattgtgctaactctcagtaacagtagtgactacctggggctaatccataagctacttccccaaattgaaatatggcagccacattcttgaaaattggaagataacggccaggcgcagtggctcacacctgtaatcccagcactatgggaggcaggacgtgcagatcacaaggtcaggagattgagaccatcctggctaacatggtgaaaccccgtctctact

SEQ ID NO: 50703 - DNA, 203 bp, Homo sapiens
  misc_feature 29: n = A,T,C or G
aacagctttcaagtgcctttctgcagggntttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgctttttttttttt

SEQ ID NO: 50704 - DNA, 333 bp, Homo sapiens
gcatctccagagggtagacattgcttgctccaagtcaattatgctgtttctgtaccccttcctgaccagctagggcacagcaatgtgctgcaattctagccaataacacacaagggagggcttcttaggagcttgaaggagtaaattttttactcttacaaaagagacactgaggaagtggcctttcggtattgtcacgtctggatgtggtattcagagctgttgcattcatcttgtgagcctgaggtgagccagacaaaatgacagagggcagacagagcccagataatctccgagaagtgggcccggatcacactacaccttatattttct

SEQ ID NO: 50705 - DNA, 321 bp, Homo sapiens
gaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttggtagtaatgctctgaccaagccgagatgcccattctcttagtgatggcggcgttagggtttgagagaagggaatttggctcaacttcagttgagagggtgcagtccagacagcttgact

SEQ ID NO: 50706 - DNA, 196 bp, Homo sapiens
gatgcctccagatttattcctttttcttagtcttgctttggctatgtggactcttttttggtgccatatgaatttttaggattgtttttctagttctgtgaataatgatggtggtattttgatgggaattgcatgcttttggcagtatgatcattttcataatattgattctacctatccatgagcatgggggtgt

SEQ ID NO: 50707 - DNA, 146 bp, Homo sapiens
attaaggatagaatcttggggttagtgtggagattagattaaatgtatgtaagacacttggcacaaaacctggcacatagtaaaggctcaataaaaacaagtgcctctcactgggctttgtcaacacgtgaaaaaaaaaaaaaaaa

SEQ ID NO: 50708 - DNA, 302 bp, Homo sapiens
caagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgaacaaatttcctttgaataattttaatgatatttatagacatgg

SEQ ID NO: 50709 - DNA, 353 bp, Homo sapiens
ataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgccctttcttgatattgcacctttggacatcggtggtgctgaccaggaattcttt

SEQ ID NO: 50710 - DNA, 220 bp, Homo sapiens
aaggaaatagcaaattcacctacacagttccggagaatggatgtacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaaca

SEQ ID NO: 50711 - DNA, 337 bp, Homo sapiens
tgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggacaaaatgccattgacatggaaatcattgtgaatgcaaagactttggatggaggcctgaatgtcattcaattagaaactgcagtaggg

SEQ ID NO: 50712 - DNA, 506 bp, Homo sapiens
  misc_feature 5, 25, 38, 39, 44, 46, 59, 66, 70, 74, 80, 82, 83, 84, 86,90, 91, 92, 112, 113, 117, 126, 129, 133, 134, 135, 136,152, 156, 157, 162, 164, 165, 174, 178, 181, 185, 186, 187,190, 191, 194, 206, 227, 231, 235, 244, 247, 251, 255: n = A,T,C or G
  misc_feature 258, 260, 261, 263, 270, 273, 274, 275, 276, 285, 287, 291,292, 302, 305, 306, 311, 318, 319, 321, 327, 328, 329, 333,348, 349, 352, 357, 363, 366, 367, 369, 371, 376, 377, 385,390, 398, 401, 405, 420, 429, 437, 440, 442, 443, 453: n = A,T,C or G
  misc_feature 455, 456, 473, 474, 477, 481, 487, 488, 495, 496, 497, 500,502, 506: n = A,T,C or G
ttggngggggggcgagatcctactngagacccttgatnntgggnanggaccgaagatcnattaganaccnatgngatggncnnncnaaannnttaaagtgagagtccatctnngaanaaaatgggnaantttnnnnggggggggggaaaaancccnngggtnanngggggcccngggnttnaaannnggnnctnggggggggaaanttttggcccccccccgggggntttncctnaaaaaaaanccntttnaaanacngnnanaattttnccnnnncggggaggngngganntttttttttnaannagccntttttgnnanaaaaannntggncccccccctattccnnggnttttnggaccnttnnancntgggnntttttagnccttnaaaaaaangcnaatnttaaggtaaaaattnggggggggngggggggnggngnntttttttttntnnggaggggtttttttccnncgngggngaaagnntggggcnnnctncngccn

SEQ ID NO: 50713 - DNA, 337 bp, Homo sapiens
tcgtactcgtgcgcctcgctttgcttttcctccgcaaccatgtctgacaaacccgatatggctgagatcgagaaattcgataagtcgaaactgaagaagacagagacgcgagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgc

SEQ ID NO: 50714 - DNA, 133 bp, Homo sapiens
gctttgtggtccagctggcaccctttctgaggtttgtgttttgtgctaaatggttttgtccttaaataggagaggctcaaaaacatcaagatttcaggaaaatggcgacagctgcataatggaacccccctgc

SEQ ID NO: 50715 - DNA, 301 bp, Homo sapiens
tttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatt

SEQ ID NO: 50716 - DNA, 340 bp, Homo sapiens
aaaaagacaaatgaatggggaaagacaatcattgaatacaaaacaaataagccatcacgcctgcccttccttgatattgcacctttggacgtcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgccatctacttgcttaaattgtgggcaaaagaggaaaagaaggattgatcagagcattgtgcaatacagtttcattaactccttccct

SEQ ID NO: 50717 - DNA, 213 bp, Homo sapiens
caatttttgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgtctctccgtgaaacttacctttccctttttctttctcttttttttttgggatattattg

SEQ ID NO: 50718 - DNA, 112 bp, Homo sapiens
aaaagaagagacattaagagttcctgaaatttatatctggcatacggataggcttatattcaaaacatcttagtcatacgaccataaattaaaagtggagtcactaaatagt

SEQ ID NO: 50719 - DNA, 204 bp, Homo sapiens
ccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggaggactccaagagtactgtgtcttcctgtcctgcat

SEQ ID NO: 50720 - DNA, 226 bp, Homo sapiens
  misc_feature 28: n = A,T,C or G
gccacccgcgaaaattcggccagggccncgctcttgtcgtgtctgttcaaaccggcacggtctgatccggaaatatggcctcaatatgtgccgcagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 50721 - DNA, 125 bp, Homo sapiens
agtgatgtggccgacgttttatcaaaggccccctttctatgttcatgttagttttgctccttctgtgtttttttctgaaccatatccatgttgctgacttttccaaataaaggttttcactcctt

SEQ ID NO: 50722 - DNA, 390 bp, Homo sapiens
gaacatagtccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcaggatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagc

SEQ ID NO: 50723 - DNA, 170 bp, Homo sapiens
  misc_feature 40, 55: n = A,T,C or G
tacaatacaggtcagagacaatggcttataaaggtttagngtggtctcaggatgngacaggcagtccagcctgacctttctgcacactccagacaaacttcccagacaagctcctttgtgcctctacgtggagagggtgtggaaagttatcacattaaaagatggaggat

SEQ ID NO: 50724 - DNA, 116 bp, Homo sapiens
  misc_feature 10: n = A,T,C or G
ctaatgctangtgttccatatcacagagcgaatttgtatttaaacaaaaatttaaattttggaatcctctaaacatttttgtatctttaattggtttattattaaataaatcatat

SEQ ID NO: 50725 - DNA, 333 bp, Homo sapiens
  misc_feature 29, 44, 49: n = A,T,C or G
ataactataaagactaagtatccacatanaaaagcttgtaagtngaatnaatcaaataaaaaactttgtcccactaaaattacaactaagtaaaaaggcgtgcatgtctatatagaaggcctagaagggactctgaaaaagtaaaaactgatttgaggggcagaaatttacttttattttaattgacattaatgttatgatgatttcggctggaacataagaggcattcaataaatatgttttgagaaagggaaaaatatgattaaagaataattcaagtaacatcctcagaccttgagcgagagtgtgtgtgtgtgtgtgtgtgtgtgtgtg

SEQ ID NO: 50726 - DNA, 245 bp, Homo sapiens
  misc_feature 15, 49, 72, 170, 174: n = A,T,C or G
cagggaggggtagcnacatgccccatgcctgccctttctttccttcttngctcactttactatgggtgtatnttaatcttgtataaaaatatgcatgaatgagtcatgcacatgtatacgttatgtatttgacaagtggtggtgaaacaaaatcaaaacagatttgattngcgnttttgaaatgtcagtacattttgtgccactaacactgtgatgtataaaagagctgtttgaatgccttttaa

SEQ ID NO: 50727 - DNA, 502 bp, Homo sapiens
  misc_feature 31, 345: n = A,T,C or G
atgcatgactccctggcacatgtaaaacagnttttttagacctaggagaaatactggattataaatacttaacagtttacattttgtttagaatagattctgaaatttgtttcaagaagaggtaataaaaatataattattcttgagtgaggcttataattccccaaaacactagtttattattatgctaatttagtgatctgcaatcaggtatcagaactatcccaaagagtgatctgcatttcagtttataaagaattatgctgatatagcctgaggcttttgtagaaattagctaataaatcaattttaaacatatgggatgaattttgaaacacacacagngagatattagctgacttcattccccagtatagaataagattctgaaatccacgctcattatagtgggaaagggatgactaagtgaagcttcttattaaacaattatctatgggaatacatgtatacatgaaataaacaagatgccacttattcttgc

SEQ ID NO: 50728 - DNA, 322 bp, Homo sapiens
agctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgccggagtggaagctgaagcctgcacagtgtccaccctgttcccactcccatctttcttccggacaatgaaataaagagttaccacccagc

SEQ ID NO: 50729 - DNA, 357 bp, Homo sapiens
  misc_feature 174: n = A,T,C or G
atctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagttncctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaag

SEQ ID NO: 50730 - DNA, 370 bp, Homo sapiens
  misc_feature 298: n = A,T,C or G
actgacaaaagactggagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcaagtttgcagttatgcagaatccaaagtaaatgtcctgctagctagttaaggattgtttaaatctgtattttgctatttgcctgntagacatgactgatgacatatctgaaagacaagtatgttgagagtttgctgtgtaaaatacgtttgaaatag

SEQ ID NO: 50731 - DNA, 179 bp, Homo sapiens
  misc_feature 32, 34, 60, 66: n = A,T,C or G
tctctgtatgtcctagaataagaagcaatgangngctgcttctgatttttcttgcatttnaaattntcagccaacctacagccatgatctttagcacagtgatatcaccatgacttcacagacatggtctagaatctgtacccttacccacatatgaagaataaaattgattaaaggct

SEQ ID NO: 50732 - DNA, 378 bp, Homo sapiens
  misc_feature 319: n = A,T,C or G
tttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgctggcccgcaatactgtaggaacaagcatgatcttgtactgtgatattttaaatatccacagtactcactttttccaaatgatcctagtaattgcctagaaatatctttctctnacctgtatttatcaatttttcccagtattttatacggaaaaaatggattgaaaacactt

SEQ ID NO: 50733 - DNA, 273 bp, Homo sapiens
tagcaattagaaaccaagaatccgctggcttgaagaacttttaatccctaaccatttccaaatgggtaaatctagggtcagtatatatcgtagctagtctgttaaaaaggaaagtcatcctgtgggatcgtgacgtggaggatccctgggtgcctaagaggcagggacgctgacgcccagaaagcgggcattgccaccgagacaaagaaaagcaaatgattgtccttcccgctgctcttggggattaaaaaacaatgaacgaattcttttatt

SEQ ID NO: 50734 - DNA, 446 bp, Homo sapiens
  misc_feature 343: n = A,T,C or G
caaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgcaaagaaggccctgaagctgatggggcaaatgaaggtgaantcaaggctgaaggaaatagcaaattcacctacacagttcttggagggatggttgcccgaaacacactggggaatggagcaaaacagtctttgaatatcgacac

SEQ ID NO: 50735 - DNA, 294 bp, Homo sapiens
cggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaat

SEQ ID NO: 50736 - DNA, 204 bp, Homo sapiens
  misc_feature 195: n = A,T,C or G
gaaactagtctacaaaaaaacatttctggaattctacgaagaaaagattaagaacaatgaaaataaaatgctcttaaaacgaatgcaggccttggagccatatcctgcaaatgagagttctaaacttgctctgagaaggtggatgactatgaacatgcagcaaagtacatgaagaacagcaagtaagggtacctntgggaacct

SEQ ID NO: 50737 - DNA, 202 bp, Homo sapiens
agagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgatgtttg

SEQ ID NO: 50738 - DNA, 133 bp, Homo sapiens
  misc_feature 7, 31, 55: n = A,T,C or G
ttttcanagtaaagagaagacttcaaattgnggaattcagaaaaactcaagattnaagttaaaaagtggtttggacttgggaacaggactttatacctcttttactgtaacaagtactcattaaaggaaattg

SEQ ID NO: 50739 - DNA, 525 bp, Homo sapiens
  misc_feature 48, 52, 513: n = A,T,C or G
gtatacttttcaagagagatgattgcctatttaccgtttgacagagtnccgnagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtgggtcaaacaggtaaagcctatgatgtgtgcatttaaagtgtcggaatttagcctctgaataccttctccattgggggaaagatattcttggaaccactcatgacatatcttagaaggtcattgacaatgnataaactaattg

SEQ ID NO: 50740 - DNA, 172 bp, Homo sapiens
atgagccctgagatgctagaagtgagaactctccaaacagccactgtgggcataatctggaaaattccctcaggtgtaaccgctcctctgcccagcaagtgaacaaagggctgactggtgacagtttctggacactgtcgcaggctatttaagcctgcaagcaagcatctct

SEQ ID NO: 50741 - DNA, 351 bp, Homo sapiens
  misc_feature 46, 47, 87, 127, 144, 262: n = A,T,C or G
ccaacaagagttacctagtgcttcctggtcatgtaaaagataattnncatctgagactgaaataacaaattattacctgtatcaacngtactatagtgcaaagggcacttaactcagatggagattngggttaaaatcaagttngtaatcttggagacccaggtgcctcacctgtaacgtaagtaacatactacctatataaaagagtaaataaacaatgtgaaagcactttatttaatttgattgtataaaatatcaatgngattctagtactacctgcatggaaaaaggaaaatagtgcccttcctaccagttaatctagattaattccccaaaatatgggatcatacg

SEQ ID NO: 50742 - DNA, 236 bp, Homo sapiens
  misc_feature 198, 199: n = A,T,C or G
agcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggnnatttttgttccacaagttaaataaatcataaaacttg

SEQ ID NO: 50743 - DNA, 420 bp, Homo sapiens
  misc_feature 365: n = A,T,C or G
acggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccgagaagaataagcacaagagaaagaaggttaagctggctgcctgaaatattataaggtggatgagaatggcaaaattagtcgccttcgtcgagagtgcccttctgatgaatgtggtcttgggggngttatggcaagtcactttgacagacattattgtgcaaatgttgtctgacttactg

SEQ ID NO: 50744 - DNA, 414 bp, Homo sapiens
  misc_feature 404: n = A,T,C or G
aaactggagagatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggccgcaatactgtaggaacaaggcatgatcttgttactgggatattttaaatatccacagnctcacttttt

SEQ ID NO: 50745 - DNA, 357 bp, Homo sapiens
  misc_feature 25, 53: n = A,T,C or G
acaagaaggctgctggagctggcanggacaccaaggctgcccagaaagctcanaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 50746 - DNA, 354 bp, Homo sapiens
  misc_feature 226, 294: n = A,T,C or G
acactgccagatccttcggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggactnctatgtggtgctgggtaggccaggtttcaggcatcggcagacaagaagcgcaggcaggcttgcattgnggccaaacacagaatcagcaaagaggagccatgcgctggttccagcagaagtatgatggg

SEQ ID NO: 50747 - DNA, 490 bp, Homo sapiens
aagcatgcaatataaacaggcttagaactatgaacagcagcagtagggagtcacagaatgaaattactgtaacacaaaataaacatagcagaataagtccacactttctcatttgaaatatacataagcaagaattaaatgtatattgagtctagttttatacaaacaaaagcctaaaaatctcataacaatagaaataccagtaaatttaaaaggattctcccaattttggccctatttccctgtctataaagaaattcctaagggcaaaaaaaaataacttcagactataaatgatgaatgtaactattaggagtggcctctctatgaggtctgaaatagaaggaaaatgtcatttcttccagagctgtagccaacaataacttttgcattccgaattcagcttagggacattggttgggaagatgtttgcaaaagtatttaataagaaaggctgaatttagcctttatttttctcagtttttaaaat

SEQ ID NO: 50748 - DNA, 314 bp, Homo sapiens
gagggggcttcaagaagtgtgcccctcaggctcttaaagagaccggaagtttgcaatgaaggagatagaaaactccagatatgtgcattgataccaggctcaacaaagctgtctgggccaaagtagtaaggaatgtccatactgtgtccatgtgcagtggatggccagaaaacataatgaggttagaaattcaccaaataagctctatactttggttatatacttgttaccactttcacaaatctacagtcagtgtggatggggaactaactgctgatcatcaaatacatcaaatgaagttataaaaactacat

SEQ ID NO: 50749 - DNA, 248 bp, Homo sapiens
tgtgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtggg

SEQ ID NO: 50750 - DNA, 294 bp, Homo sapiens
  misc_feature 108, 145: n = A,T,C or G
atcttcgtgaagaccctgactggtaagaccatcaccctcgaggtggagcccagtgacaccatcgagaatgtcaaggcaaagatccaagataaggaaggcatccctccngatcagcagaggttgatctttgctgggaaacagctgnaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 50751 - DNA, 147 bp, Homo sapiens
accctgattcggcctgatggagagaagaaggcatatgttcgactggctcctgattacgatgctttggatgttgccaacaaaattgggatcatctaaactgagtccagctgcctaattctgaatatatatatatatatatatatcttt

SEQ ID NO: 50752 - DNA, 245 bp, Homo sapiens
ctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagatt

SEQ ID NO: 50753 - DNA, 319 bp, Homo sapiens
  misc_feature 85, 288: n = A,T,C or G
taaggaataaagcaataaaatcattgttctctatgtccctccttgtgacaaatagagcaataaaattctaaaggcttttgatgtngaaagttgtttaagatttttttccccagtcttttggcttcatgtcacgtttgagtcctcattacaatcatagtcactagattagtcatcaagggtaccttgtatttttctccattaataaggcatcatggtttattttaagaaccaaaggaacctagtcagaggcataataataaacaatgtagttccctagcatcatttgantaaaagggccaatttgcattaaaattaatgg

SEQ ID NO: 50754 - DNA, 452 bp, Homo sapiens
  misc_feature 33, 35, 54, 379: n = A,T,C or G
gtgactgctgacaaagatgcgtgtgcccgatgngnctattgaagattctgtganctcactctcaggagaccattgcatcattggccgcacactggtggccatgaaaaagcagatgacttggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtggactttttcagagttgctttaaagtacctgtagtgagaactgatttatgatcacttggaagattgnatagtttataaaactcagttaaaatgctgttcaatgacctgatttgccagacttaaatcacagatgggattaa

SEQ ID NO: 50755 - DNA, 236 bp, Homo sapiens
tgagcttgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtgg

SEQ ID NO: 50756 - DNA, 123 bp, Homo sapiens
taacccctataccttctgcataatgaattaactagaaataactttgcaaggagagccaaagctaagacccccgaaaccagacgagctacctaagaacagctaaaagagcacacccgtctatgt

SEQ ID NO: 50757 - DNA, 168 bp, Homo sapiens
tttcccatctgagtatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgcca

SEQ ID NO: 50758 - DNA, 190 bp, Homo sapiens
  misc_feature 38, 40, 124, 146, 182: n = A,T,C or G
cggattatttgcccaaatcttcttcagattcagcattngntctttgccagtctcattttcatcttcttccatggttccacagaagctttgtttcttgggcaagcagaaaaattaaattgtaccnattttgtatatgtgagatgttnaaataaattgtgaaaaaaatgaaataaagcatgttnggttttcc

SEQ ID NO: 50759 - DNA, 441 bp, Homo sapiens
ttaggctaaaattaagactatgtaaacatcagaggatttacagtagaaagaactaaggaactaacacttcagactttaaaataaatcagagtattaagtataacaaaagttgaacctgttagaaaatttccttgtatataagttgaaaagtaggtttttgaagagatatattcgaaatatattttttcacttgaaaaaagtaaaaatttttttcaaaggcaaataattcaactctaaaattatactatttcaacattctcatttatgtgaaagcatgtgataaattgttgctgcgcagagatatgagaaattcctttgcattaggtgggcattattcatagacttctacatgaaagagaagagaaataaaagatgcaccaggaaaatctgagcagagaggcttttagtgggtgacttactggagtgatgcctgaagtaggt

SEQ ID NO: 50760 - DNA, 323 bp, Homo sapiens
  misc_feature 142, 242: n = A,T,C or G
aagtcagaactaaaggagctgctgacccgggagctgcccagcttcttggggaaaaggacagatgaagctgctttccagaagctgatgagcaacttggacagcaacagggacaacgaggtggacttccaagagtactgtgtcntcctgtcctgcatcgcatgatgtgtaaccgaattctttgaaggcttcccagataagcagcccaggaagaaatgaaaactcctctgatgtggttggggggnctgccagctggggcctccctgtcgcagtgggccctttttttttccaccctgctccttcagacacgtgcttgatgctgagca

SEQ ID NO: 50761 - DNA, 480 bp, Homo sapiens
  misc_feature 458: n = A,T,C or G
attagccagcagaggaggaagagaaggctaaggtagaagagcagaaacgtaacaagcagctagaagagaaaaaacgtgccatgcaagagacaaagataaaaggggaaaaggtagaacagaaaatagaagggaaatgggtaaatgaaaagaaagcacaagaagataaacttcagacagctgtcctaaagaaacaggtacagtaaacattttgcaccaaatgtgtgatgcctgtgacttgtgagaaatgtaatgcacatctgatttgggactgaggccacatgcatatagctcacatgcttgatcatttggcaagctgttcattttttcaggccatagcgatacacaagcatgcagcaattgattgatggcttgaatattcaatcaaccaaatttactgggacagccagtaaatttggctgtccagaagacagagagaaattaatgctctgtgcttgatngtatgaatacccaaaaaaagaa

SEQ ID NO: 50762 - DNA, 394 bp, Homo sapiens
  misc_feature 85: n = A,T,C or G
aggaagaggccatgtttcagttcgttttctctgtagggtccgattgaattggaccttttcagttgttcagaaaaataaaaataanttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactggtgtgaaagtgaaaaacaatgattggatgggtactcaaagtataatttctactgaatgcatatcacttg

SEQ ID NO: 50763 - DNA, 348 bp, Homo sapiens
  misc_feature 15: n = A,T,C or G
agaggctcttcaggntctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaataatctggtaaatttg

SEQ ID NO: 50764 - DNA, 173 bp, Homo sapiens
  misc_feature 39, 44, 56, 89: n = A,T,C or G
gtcctacgtgatctgagttcagaccggagtaatccaggncggcntctatctacttnaaattcctccctgtacgaaaggacaagagaaanaaggcctacttcacaaagcgccttcccccgtaaatgatatcatctcaacttagtattatacccacacccacccaagaacagggt

SEQ ID NO: 50765 - DNA, 192 bp, Homo sapiens
  misc_feature 30, 83, 100, 111, 115: n = A,T,C or G
tctttctcttacctgttatttatcaattcntcccaggatttttatacggaaaaaattggattgaaaacacttagtatgcaggngataagaggaatttggnataattatggngggngattattttttatactgtatgtgccaaagctttactactgtggaaagacaactgttttaataaaagatttacattcc

SEQ ID NO: 50766 - DNA, 450 bp, Homo sapiens
  misc_feature 67: n = A,T,C or G
tgcattccgagaaggttggagatggttccggcaaccagtccaggttccagtaactttggtccgaaangatggaatcatttattccaccagccttacctttacctacacaccagaaccagggccgcggcacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtgacaaaaagttaacaaaaaaggagaaaaaatgaacaatcgtttgtggtttcttgggaaaacttttcataccagggtgatactattcaaaaaccccgttgctccctgcaggtgctgatttgaaatgcagaagccac

SEQ ID NO: 50767 - DNA, 456 bp, Homo sapiens
  misc_feature 22, 33, 34, 43, 47, 343: n = A,T,C or G
ttgtataattgttaatcacttngcaaatagggnntatcaaatnaccnatattggcattgctggattataaactctatatctgtaatataaagtgtttgagtttttaattgggctgttatggatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacggaaatgtaaatggcctctacagagttttatggaatacctggnactaacgtaggcagctgcaaaaccacactgagttacagctgtcagccctcctcattcctaaataactgccttacatatcagccctcccacttctgaagttcaaaataaggcct

SEQ ID NO: 50768 - DNA, 438 bp, Homo sapiens
  misc_feature 29, 362: n = A,T,C or G
tgaagctgacagcattcgggccgagatgnctcgctccgtgtccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcaagacttgtctttcagcaaggactggctttctatctcttgtactacactgaattcacccccactgaaaaagatgagtatgcctgccgtgtgaaccatgtgactttgcacagcccaagatagntaaagtgggatcgagacatgtaagcagcatcatggaggtttgaagatgccgcatttggattggatgaatttccaaa

SEQ ID NO: 50769 - DNA, 238 bp, Homo sapiens
agaagaaatcctgacacccagtggatcaccaaaccagtccacaagcacagggagatgcgtgggctgacatctgcaggccgaaagagccgtggccttggaaagggccacaagttccaccacactattggtggctctcgcgggcagcttggagaaggcgcaatactctccagctccaccgttaccgctaatataagtaaagtttgtaaaattcatacttaataaacaatttaggacagcc

SEQ ID NO: 50770 - DNA, 333 bp, Homo sapiens
  misc_feature 28, 66: n = A,T,C or G
catctctaagtgcctcattgagttcggngcatctggccaatgagtctgctgagactcttgacagcncctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttaagcagatgtttaatttttttttaacaacattaacttgtggctctttctacacctggaaatttactcttgaataaataaaaactcgtttgtcttg

SEQ ID NO: 50771 - DNA, 131 bp, Homo sapiens
gaggaaatggcctaaggtcacaacatatcttctaggtgaggaaacttagtcttaaactcatatcttctgatttcaagaccaacgccttttctttccaataccattctgtttcccggtttagtaatgtcagt

SEQ ID NO: 50772 - DNA, 336 bp, Homo sapiens
atttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccatagctttctgggctttctctttttaaagcagactgtggaaggttcttctatctta

SEQ ID NO: 50773 - DNA, 205 bp, Homo sapiens
tgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtc

SEQ ID NO: 50774 - DNA, 274 bp, Homo sapiens
  misc_feature 13: n = A,T,C or G
tgaaactcacatncatatcacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatgga

SEQ ID NO: 50775 - DNA, 332 bp, Homo sapiens
gatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttc

SEQ ID NO: 50776 - DNA, 221 bp, Homo sapiens
caaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaatcctgtcttgttcataaattgacaatgtcaataaattgaaatatggttcactgtt

SEQ ID NO: 50777 - DNA, 131 bp, Homo sapiens
  misc_feature 84, 91, 93: n = A,T,C or G
tacgtatattctttttccatccacttgcacaatatcattaccatcactttttcatcattcctcagctactactcacattcagtnaatggtntntgtaaacatttttaagacagttgggatgtcacttaaca

SEQ ID NO: 50778 - DNA, 304 bp, Homo sapiens
gtgcttgttccgtgatatgagacagacagttgccggtgggtgtcatcaaagcagtggacaagaagactgctggagccggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggccactttggttttcttttttgc

SEQ ID NO: 50779 - DNA, 421 bp, Homo sapiens
  misc_feature 322: n = A,T,C or G
gaaaggaagaaaaattaactccattcctactgggtgacttttattatcagatagcaatctgataactgattattattagttcggtgacaataattatttttggatgcttggttgctaataatttgcctgatgcctagaaaattctgatttggggtctgtattctagtgggcatatagcccaaattagcaatcagattcttctactaaaattatctgatcaagctttcagataattcatgcatttacatagaatacatatcagtgggtttaaacagaatttcacagacgctttcccattgaagctgattgtttgcaaaatggngagcatgctttactgccaactcacacaccagtgttgatataatcagttacctgaccaagatcaaagcagcagaatagaagatagtaccttggctctgat

SEQ ID NO: 50780 - DNA, 422 bp, Homo sapiens
  misc_feature 54: n = A,T,C or G
tcataattacattgtcttgatttagaatgtgattacattaatgctagatcatgntgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagcacacatgaaagaagccatgatcaagcttggttccacttgctctgcttcttcatgtatctttatagtatgatcttagctttgataaatgactgaagctggagaagccgtgtttgaagtcagcctacactacagtgcacagttgaggagccggagcttcttaaat

SEQ ID NO: 50781 - DNA, 143 bp, Homo sapiens
aagctagcacataattatccttctgttcttagatctgtatcttcataataaaaaattttgcccaagtcctgtttccttagaatttgtgatagcattgataagttgaaaggaaaattaaatcaataaaggcctttgataccttt

SEQ ID NO: 50782 - DNA, 230 bp, Homo sapiens
  misc_feature 204, 206: n = A,T,C or G
ggaagctgggtgtaagattgattcagcattccatgcacttgctttaaaatttagtcctgtgcatactgtggtgtgtttactgtgcatatttgaatttttcatgcagtttttctagagcaataatcagtggtgcctttgtacctaggttttatgtgattttaatgaagcatggatagttgtggccacctgctgactatttgtggntnaaaataaaaggtttacttgtctgc

SEQ ID NO: 50783 - DNA, 304 bp, Homo sapiens
gaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtc

SEQ ID NO: 50784 - DNA, 377 bp, Homo sapiens
  misc_feature 8, 29, 38, 47, 67, 359: n = A,T,C or G
tgacaaanataccaaaataaaagtgtatntttaagttnccatttganattgctggcgctgctggccnggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggttctgttttttggtattaaaatggntttcctattttgcttatt

SEQ ID NO: 50785 - DNA, 394 bp, Homo sapiens
  misc_feature 35: n = A,T,C or G
aaatgaataacatatggtggactgttatgaagagnatcggccgaaaggcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgcataaagaatttcttttatttttgaaatcgagtttgaaatgtccttttaagaagggagatatgaatccaataaataaactcaagcttggc

SEQ ID NO: 50786 - DNA, 364 bp, Homo sapiens
  misc_feature 272: n = A,T,C or G
gaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggttgctgagaatacagatcaacccacagaacaaagcggatttccaaggcatctccccagagcgagcctttgctgattttctctttgccagcaccatcctgnaccttgtggcatgaactttgttggctgaatcattctcattacttaattgaggagtaggagactaaaagaatgtcactctttgaatttcctgg

SEQ ID NO: 50787 - DNA, 306 bp, Homo sapiens
aaactcaatgctttatttgtaaatttagtgtttttttatttctactgtcaaatgatgtgcaaaaccttttactggttgcatggaaatcagccaagttttataatccttaaatcttaatgtcctcaaagcttggattaaatacatatggatgttactctcttgcaccaaattatcttgatacattcaaatttgtctggttaaaaaataggtggtagatattgaggccaagaatattgcaaaatacatgagcttcatgcacttaaagaagtatttttagaataagaatttgcatacttacctagtgaa

SEQ ID NO: 50788 - DNA, 318 bp, Homo sapiens
cagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattgccaacaccagggttgtattctatgggatgcattattttgaattaagaattag

SEQ ID NO: 50789 - DNA, 172 bp, Homo sapiens
cggaaatagcatatctttgtgctttattatcctggggacagtaccgactatgtaggctgtgacttgcgctgttttttagagcacttggcaaatcagaaatgcttctagctgtatttgtatgcacttattttaaaaagaaaaaaaaagccaaatacattttctgacattgttc

SEQ ID NO: 50790 - DNA, 260 bp, Homo sapiens
cttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatgggtcctga

SEQ ID NO: 50791 - DNA, 134 bp, Homo sapiens
  misc_feature 40, 42: n = A,T,C or G
agagatagagaaacagacccaagaaatgtgctcaattgcnangggccacatacctagatctccagatgtcatttcccctctcttattttaagttatgttaagattactaaaacaataaaagctcctaaaaaatc

SEQ ID NO: 50792 - DNA, 300 bp, Homo sapiens
  misc_feature 273, 290: n = A,T,C or G
atgaaagaagtgacaaatttgctccaagattaactaaaacattcaaagagacttacactggcacaacacccatttgtcacctaatgtatgcagtaaacgtgcagagttttctaggatatgttttaaccttctctccagctccccactcctgcagtcaaaacctaggaagccaatcatttattaatattactatattatgtggacaacatactcattggtaagaaaaaaaaaagcaatctctgaattcctttctagtgttgaaatactactttnactactttgtggctggnctctcatatg

SEQ ID NO: 50793 - DNA, 422 bp, Homo sapiens
cagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctgggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatatt

SEQ ID NO: 50794 - DNA, 140 bp, Homo sapiens
gtagaaggctaaggacttaccatcatttaaatacccactttcaggagctggcaaaaaacacagaaaaggatccagagagatagaagaacaagatatcatggaggaaataagcataaatgtccaacagaaatctaggatgc

SEQ ID NO: 50795 - DNA, 284 bp, Homo sapiens
tgtatatctgtatatatgtatatatgtatgtatatttaaggaagtccagaaatcatactgcatacatgctacaaaaaagtagcaaaaaaagtacaaagttggcttagataacttgtaccattttaaatggagatcataattttatgttcacttgatggggaatgactagaatgggcaataacaaatcatttctaaacagttattttccattaaaagccatattaagtattttgcttggtaaattctagtttatgttttaaatctcttagtggtacattgccatt

SEQ ID NO: 50796 - DNA, 141 bp, Homo sapiens
aaccttcagaaggaaagaatgttttgtggaccattttttttgtgtgtggcagttttaagttattagttttcaaaatcagtactttttaatggaaacaacttgaccaaaaatctgtcacagaattttgagaccattaaaaca

SEQ ID NO: 50797 - DNA, 322 bp, Homo sapiens
aaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataaggg

SEQ ID NO: 50798 - DNA, 552 bp, Homo sapiens
  misc_feature 341, 444, 473: n = A,T,C or G
tatgtgtgagctggatgcccagtcgtacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgnagtctatttgctgtatatgctgaaatttttgtatgccatttagtatttttataggttaggaaaatatttctaagaccagtttagatgctcttattcctgtagnaatattcaattgctgacctgcttggtggntagaaggaggctagaagatgaattcaggcactttctttcaataaaactaattatggctcattccctttggaaaaaaaaa

SEQ ID NO: 50799 - DNA, 460 bp, Homo sapiens
  misc_feature 209, 321, 357, 406: n = A,T,C or G
atgaagaaggggaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgnctaagaaattgaatactttgaatgtgtttcacagtttgaaataagctatttgatgtaatacttcttgggcgtatcccatgaacttagattttacatgaagtattttttcagnattatatgtccctctgaaatacatagggatatgcgnattataccaaaatggtgctggaaaaatgggcacttaaagctttcagaanatggcagtgcctgatgtagcatgcttgtggaattgccttttttctgtataaatg

SEQ ID NO: 50800 - DNA, 111 bp, Homo sapiens
aagatccttagagcccaagaaattgaggccgcagaaagctgtaataacaccactgcactccagcctggacaacagagcgagaccttgtctcaaataaaaaaaaaaaaaaac

SEQ ID NO: 50801 - DNA, 145 bp, Homo sapiens
  misc_feature 126: n = A,T,C or G
acgatgagagttgaacactttccactttttgacaccttatcctgatgtatggttccaggatttggattttgattttccaaatgtagcttgaaatttcaataaactttgctctgtttttctaaaagnaaaaaaaaaaaaaaaaaag

SEQ ID NO: 50802 - DNA, 490 bp, Homo sapiens
  misc_feature 443: n = A,T,C or G
taacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttggttacctccctccattcattcacatgctcatctgagaagacttaagttcttcagctttggcaataactgcttttagaaactgtaaagtagttacaagagaacagttgcccaaagactcagaatttaaaaaaaaaatggagcatgtgtatttatgtgggcaatngcttcactctaacttgggttttgagactaaaaccattcctcactggt

SEQ ID NO: 50803 - DNA, 470 bp, Homo sapiens
  misc_feature 104, 178, 253, 298, 382, 419, 461: n = A,T,C or G
acaagagctacatcgaggggtatgtgccatcacaagcagatgtggcagtatttgaagccgtgtccagcccaccgcctgccgacttgtgtcatgccctacgttgntataatcacatcaagtcttacgaaaaggaaaaggccagcctgccaggagtgaagaaagctttgggcaaatatgncctgccgatgtggaagacactacaggaagtggagctacagatagtaaagatgatgatgacattgacctctttggntctgatgatgagggaggaaagtgaagaagcaaagaggctaagggnagaacgcttgcacaatatgaatcaaagaaagccaaaaaacctgccttgttgccaagtcttccatcttactagatgtgaaccttngggatgatgagacagatattggcgaaattagaggagngcgtcagaagcattcaagcagacgggttagtctggggctcantctaaacta

SEQ ID NO: 50804 - DNA, 384 bp, Homo sapiens
tgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgcctt

SEQ ID NO: 50805 - DNA, 478 bp, Homo sapiens
  misc_feature 132, 347, 437, 439: n = A,T,C or G
ctctctttctggcctggaggctatccagcgtactccaaagattcaggtttactcacgtcatccagcagagaatggaaagtcaaatttcctgaattgctatgtgtctgggtttcatccatccgacattgaagntgacttactgaagaatggagagagaattgaaaaagtggagcattcagacttgtctttcagcaaggactggctttctatctcttgtactacactgaattcacccccactgaaaaagatgagtatgcctgccgtgtgaaccatgtgactttgtcacagcccaagatagttaagtgggatcgagacatgtaagcagcatcatggagggtttgaaagangccgcatttggatgggatgaattccaaattctgcttgcttgctttttaatattgatatgcttatacacttacactttatgcccaaaatgnangggtataataatgttaacaagggacatgatcttctttat

SEQ ID NO: 50806 - DNA, 372 bp, Homo sapiens
  misc_feature 236: n = A,T,C or G
tttaaattccagggaccactgggttgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgnttgattcagcaaaaatctcccagtgacaacatcgcaatagttttttacttctcttaggtggctctgggaatgggagaggggtagggatgtacagggggtagtttgttttagaaccagccgtattttacatgagctg

SEQ ID NO: 50807 - DNA, 495 bp, Homo sapiens
  misc_feature 100, 115, 146, 274, 297, 331, 366, 457, 467: n = A,T,C or G
tttgaaagatagagattaatacaactacttaaaaaatatagtcaataggtactaagatattgcttagcgttaagtttttaacgtaattttaatagcttangattttaagagaaantatgaagacttagaagagtagcatgaggaangaaaagataaaaggtttctaaaacatgacggaggttgagatgaagcttcttcatggagtaaaaaatgtatttaaaagaaaattgagagaaaggactacagagccccgaattaatccaatagaaggcantgcttttagattaaaatgaaggngcttaaacagcttaaagtttagtttaaaagttgnagggggattaaaataatttgaaggcgatcttttanaaagagattaaaccgaggggattaaaagaccttgaaatccatgacgcagggggattgccgccatttaaagcctagttaccgcctttactanacgcagaccnaaattgggaaggattaattggggagggg

SEQ ID NO: 50808 - DNA, 512 bp, Homo sapiens
  misc_feature 327, 408, 443, 498: n = A,T,C or G
cacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtggatatcttcatagnggggctattacagggcaggaaaatgttttaactgggttacaaaatccatcaatactttgtgtcattcccctgtaaaggcanggagacatgtgattatgatcaggaaactgcacaanattattgttttcagcccccgtgttattggtccttttgaactgttttttttttttnttaaaagccaaatt

SEQ ID NO: 50809 - DNA, 380 bp, Homo sapiens
tgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaaggcctaaaagcagccaccaattaagaaagcgttcaagctcaacacccactacctaa

SEQ ID NO: 50810 - DNA, 388 bp, Homo sapiens
  misc_feature 374: n = A,T,C or G
accttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtggcaaagccttcaatcagggcaagatcttcaagtgaacatctcttgcatcacctagctgcctgcacctgcccttcagggagatgggggtcattaaaggnaactgaacattaaa

SEQ ID NO: 50811 - DNA, 485 bp, Homo sapiens
  misc_feature 423, 425: n = A,T,C or G
aagaaaaagcgaaggaatttcgcagagctgaagatcaagcgcctgagaaagaagtttgcccaaaaggtgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaaccagaggtatcaatggagtgagcccaaaggttcgaaaggtgttgcagcttcttcgccttcgtcaaatcttcaatggaacctttgtgaagctcaacaagcttcgattaacatgctgaggattgtagagccatatattgcatggggggtaccccaatcttgaagtcaagtaaatgaactaatctacaagccgtggntntggcaaaatcaataagaagccgaattgcttttgcagataacgctttgattgctcgatctc

SEQ ID NO: 50812 - DNA, 176 bp, Homo sapiens
gcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccac

SEQ ID NO: 50813 - DNA, 117 bp, Homo sapiens
  misc_feature 32, 39, 56, 62, 72, 84, 86: n = A,T,C or G
gagcaacgggcggccgcagcgttagcatctgntctttgnattcagctggccctggnatgtgnaagtgaaganaatttgaaaacncntggaccaatcctaaaagaaaaataattgtga

SEQ ID NO: 50814 - DNA, 358 bp, Homo sapiens
  misc_feature 244, 267: n = A,T,C or G
cactcagttgccaagcaaggaggagagatgtacatgggctgtgttggcatgtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgngaagatagtattttaatatttgnacaaagttaatttaattttaattgtctatgtatataactgcatttctaaataattaaaaaaaagttcttatgaaggcagaaaaaaaaaaaa

SEQ ID NO: 50815 - DNA, 141 bp, Homo sapiens
gatgattttcttcatctcataattaaaatacctgactttagagagagtaaaatgtgccaggagccataggaatatctgtatgttggatgactttaatgctacattttaaaaaaagaaaataaagtaataatataactcaga

SEQ ID NO: 50816 - DNA, 282 bp, Homo sapiens
  misc_feature 168, 201, 208: n = A,T,C or G
aggcaggaggacatgaattattcaactaaatttgtagatttgttcctcccccgcaccccccacttttttttggccatttttgctttatttatttcgaagttttctgttggtgtatacacgtttatgattgtatggcttcttgatgaactgacctctttattattatgnaacatatctcttcatgctagttatattccttgnctgaagnccatttcatctggtattagtgttgccactcgtgctttcttttgattaaagtcacatgatatatcaaaaaaaaaa

SEQ ID NO: 50817 - DNA, 376 bp, Homo sapiens
  misc_feature 305: n = A,T,C or G
gaccatgtagccttggtgtagagtaggccataccattgaggattgtggaaatgcactctgtgatgtgatgtttctcacatggatgacattgcctttcacagaacgtgtcctcatcatcaagcaacacgtgactgtactaattttaaaagtatttgcttcttacaaatagtgaagtgtttgcagatagcatggtttatacctagaatttgcttcagaatagctcagtacaaggaagaggtgtgggtagggaataaagatgaaatagatgtagccatgctttcataattagtcaagctatagcgatnggtgcacaggggtcattcttctaatgctacttttggtggatgcttgacttttccagactaaaagataagcc

SEQ ID NO: 50818 - DNA, 486 bp, Homo sapiens
  misc_feature 219: n = A,T,C or G
aaatattaaaaatgtaatattaaagataattatacaaatacaatggtggtgcagtggaatggctgtatgttcacctttgcttgtgcaaagaggtgagcattagagaggacctcttagaaacagtggtacttgaactgagttttgatgaatgaataaaggttcattgctcagaagaagtgggtatacattcttaggtagaaagatagcatgaagaattancaaggcatgaagcagcatggcatttgctttgaaatgatttaagcatttaatatggctggaacgtaggtgtatgttggcagtggcaggagctgagattgggagatgggaggcagaaaccagctcatggaaggctctatatgctacatttggtttaggctttatcttataaatgatggaaaactattaagggatgggaattggtgctattaattatcattgccttcttacatgcctttttcataaaatcaactttttaaaccacttttg

SEQ ID NO: 50819 - DNA, 488 bp, Homo sapiens
  misc_feature 461: n = A,T,C or G
tacagccgctcagtgagactccagcagccaagatggtgaagcagatcgagagcaagactgcttttcaggaagccttggacgctgcaggtgataaacttgtaagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccaagtttttttaagaagggacaaaaggtgggtgaattttcttggagccaataaggaaaagcttgaagccaccattaatgaattagtctaatcatgttttctgaaaatataaccagccattggctatttaaaacttgtaatttttttaatttacaaaaatataaaatatgaaggcataaacccagtttgcatctgcgntgacaataaaacattaatgcttacaca

SEQ ID NO: 50820 - DNA, 100 bp, Homo sapiens
aacccaggaagtggaggttgcatgtgagctgagatcgcaccactgcactccaacttgggtgacagggttgagattctgtctcaaaaaaaaaaaaaaaaaa

SEQ ID NO: 50821 - DNA, 538 bp, Homo sapiens
  misc_feature 60, 368, 395, 406: n = A,T,C or G
tctccccaaatatgtgcagcaagttcaggtgacctgctttaatgagctggagatcatggnccacccagaaggtattattcctgttctcaccttcttgaaggatcacacaaatgctcagttccgcaatctggctgatctgacagctgtggacatcccttcaaagcagaaccgctttgagattgtgtacaatctgctgtccttgcattataactctcgtatccgagtaaagacctacacggatgagctgactcctcttgactcctctgtgcctgtgtccaggcgtctaactggtatgagagagaggtttgggacatgtttggaggttttcttcacaaaccatccagatctgagacgcatcttggcaagantatgggatttgaaggccatccattcanggaaagatttnccggtatctggatatgtggaggtgcgctattgatgatgaagtgaaaccgggttggggcagaacctggggagctggctcaagagttccgtaagtttgacttgaacagtccatggggaagcattttcctggata

SEQ ID NO: 50822 - DNA, 399 bp, Homo sapiens
  misc_feature 310, 345: n = A,T,C or G
atgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaaggttagtttaaaagttgnaggtgattaaaataattggaaggcgatcttttaaaaagagattaaccgaggggg

SEQ ID NO: 50823 - DNA, 110 bp, Homo sapiens
tgtttaaaatcagtactttttaatggaaacaacttgaccaaaaatttgtcacagaattttgagacccattaaaaaagttaaacgtttcccaaaaaaaaaaaaaaaaaaaa

SEQ ID NO: 50824 - DNA, 568 bp, Homo sapiens
  misc_feature 499, 537: n = A,T,C or G
tgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatgaagtgcctgtggaaataactgaaaaagagacacgagaagaaccgaatcattacaggtcctgaaataaaatacactaggatttctactggaggtggagaaacagaagaaactctgaagaaattgttacaagaagcacacccgtgagggaagttgcaagccaacaaaaaagtcaaggatctagaagacgattaagggaaggtcgtctcagtgaaaatccaaaaaccagaaaaaaatgttatacaccctaagtcaatacctgaccttagaaaattgngagagcccaagttgacttcagggacctgaacatcagcncaaagaagcatcatcaaataattctgacaca

SEQ ID NO: 50825 - DNA, 512 bp, Homo sapiens
  misc_feature 217, 218, 345: n = A,T,C or G
cgttagcacgaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggnnctacaagccaaatcagatgagaaggcggcggttgcaggcaagaagcctgtggtaggtaagaaaggaaagaaggctgctgttggtgttaagaagcagaagaagcctctggtgggaaaaaaggcagcangctaccaagaaaccagcccctgaaaagaagcctgcagagaagaaacctactacagaggagaagaagcctgctgcataaactcttaaatttggattattccataaaggtcaaatcattttggacagcttttttttgaataaagacctgattatacaggccggggggaa

SEQ ID NO: 50826 - DNA, 202 bp, Homo sapiens
actctagaggccagaggaagaggcattgacatttttaaatgctgaaagagaagagctgtaaacattaaatcctttatcagtgaaaggattcttcaggaattaggaggaaatagacattctcaaatgaaggaaaattaacagaatttgttgctagcagaacttctcttgaagaacggctaaaggaaactttcataaaaaaaaa

SEQ ID NO: 50827 - DNA, 289 bp, Homo sapiens
  misc_feature 43, 53, 170: n = A,T,C or G
caagaatgttaatgtcaatcatgccagtggactagcacatggnagacgcttgnaacccactcacaccaatccagtgaccgtgtgtgggctggcggctcttctcccccaccaacggaacccctgtgtgcaccaatcttccccagagctccggagcgccctctcctcacttncaggttttggagcaagagcttgcaggaagcccgacccagcttccttctgaccttcagttcactttgtcgcccttggagaaagctgtttttctttaactaaaaataaccaaaaaaaaaaa

SEQ ID NO: 50828 - DNA, 411 bp, Homo sapiens
  misc_feature 249: n = A,T,C or G
cgctctgctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttntgataggaagtatgtttgtttcttagtgtttacaaatattaagtactcttgatacaaaatatacttttaaacttcataaccttttttataaaagtgttgcagcaaaataatagcctcggttctatgcatatatggattagctataaaaaatgcaataagatg

SEQ ID NO: 50829 - DNA, 548 bp, Homo sapiens
  misc_feature 371, 468, 537: n = A,T,C or G
cactgataatgcatggatggagacagaagctgtgaactaccatgacgaaacaggtgagataatggataatcttatgctagaagctggagatgatgctggaaaagtgaaatgggtggcatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaattatactataaaaagagcagggtaggccacttggcctatttactttcaaaacaatttgcatttaagagtgntcgcatcagaataacatgagtaagatgactggacacaaaattttcaagctcttggtcaaaaggaatataaagtaatcatattttggatggattcganttaagcatggctttaaattaaatttaaacaactaatgctttttggaggaatcttaatcggaataagganaaatctttgac

SEQ ID NO: 50830 - DNA, 172 bp, Homo sapiens
cggacttcacgtcattattggctcaactttcctcactatctgcttcatccaccaactaatatttcactttacatccaaacatcactttggcttcgaagccgccgctgatactggcattttgtagatgtagtttgactatttctgtatgtctccatctattgatgagggtctt

SEQ ID NO: 50831 - DNA, 265 bp, Homo sapiens
  misc_feature 21: n = A,T,C or G
gcccttgcatatatgcaatgnttgataaacaaacctactctgcacacagataacaaggatttagaagttaattcctaccggcacaaacaaatactcatgtatagcagtcttactgaacttccgtgttcagttttaggctgtaaaacttgagtgaaatctgaagaactttttaaggtccaaaaggaattgagaaagacttggaaaacaggacctttgaagaaagcttacaggagacagaattcgagcttagaaaacaatgcatgtg

SEQ ID NO: 50832 - DNA, 170 bp, Homo sapiens
  misc_feature 19: n = A,T,C or G
aacacttcagctgacatantaacttcttgttgaagagctatttaatttgaatagaatctgagccgttacagtggtaggaagattttatgtaacctcatttttctattgatgaaaactccactacctttaagatctaaaaagataagacatctgccattaaaaaaaaaaaa

SEQ ID NO: 50833 - DNA, 503 bp, Homo sapiens
  misc_feature 55, 82, 85, 388, 441, 473: n = A,T,C or G
tgttttttttcttttaaatgtaatacctcctcatcttttcttcttacacagtgtntgagaacatttacattatagataagtngtncatggtggataacttctacttttaggaggactactctcttctgacagtcctagactggtcttctacactaagacaccatgaaggagtatgtgctcctattattcctggctttgtgctctgcaaacccttctttagcccttcacacatcgcactgaagaatatgatgctgaaggatatgggaagacacagatgatgatgatgatgatgatgatgatgatgatgatgatgaggacaactctctttttccaacaagagagccaagaagccatttttttccatttgactgttccaatgtggccattnggatgcagtgctattcacgagtgacattgctcaaatttagggttgaccttagncccaaccaacattccatttgaactcgaagctngaccttcaaaacaataaaattaagggaatc

SEQ ID NO: 50834 - DNA, 530 bp, Homo sapiens
  misc_feature 348, 445, 472, 495: n = A,T,C or G
aaggcttcttttcattattttttatgtttcacttataaagtcttaggtaactagtaggatagaaacactgtgtcccgagagtaaggagagaagccactattgattagagcctaacccgggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggngacaacctactttgcttggctgagtgaaaggaatgatatcatatattcatttattccatggacatttaggtagggctttttatataccaggcatganctggagggacactcttgggtatatttncaaaattttggacagtcgctgcncatatttgaaaccttatattaagactttccaaaga

SEQ ID NO: 50835 - DNA, 431 bp, Homo sapiens
  misc_feature 45, 395: n = A,T,C or G
ttctaaattcttgaagtctggtgatgctgccattgttgatatggntcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcaagtggtggaagaacggtctcaagaactgtttggttcaattggccatttaagtttaagtagtaaaagactggttaatgataaccaatgcatcgtaaaaccttcagaaggaaaggagaatgttttgggggaccactttgnttttctttttgcgggggcaggttttaagttattaag

SEQ ID NO: 50836 - DNA, 527 bp, Homo sapiens
  misc_feature 403, 428, 507: n = A,T,C or G
tttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagactattcagagagatggaatcaatccttcaaaacaagcatcttgatgtggagaaaattggtaatctctttcctcagtgacaaaagatgaaattcaaatttatcagtcaaaggtaggtcttagtgatcatatgggcagctaatattaggtcttaagngatcagggggcagtaatcttcaagncagaatctatcaccttggtaaattatataaacctaacttgagcagatctgaatattccttggataggaattcaaggggnatcttgactattaaacctcc

SEQ ID NO: 50837 - DNA, 330 bp, Homo sapiens
tgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggaagtctgcattgtagtgtctcaaagacacaataaacttcctatggtctgcaaaaaaaaaaaaaa

SEQ ID NO: 50838 - DNA, 370 bp, Homo sapiens
catttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagtcctccatttaacagatatgaagagcattttaaagaggtgcagctctggaagtggatcaaactagaactcatatgccatactagatatgttttggcaataaacttatgacggggg

SEQ ID NO: 50839 - DNA, 329 bp, Homo sapiens
  misc_feature 17, 261: n = A,T,C or G
tgttggtgtcatatggntcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagggctcctacactttgaaaacttaagaatcccttatcatgaaggttgcctgttctagaattgnaaagattggtaatttccttcaatctctagtgacaacacttaatttcttttctaataaaaaaaacctat

SEQ ID NO: 50840 - DNA, 302 bp, Homo sapiens
gcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaaattgtattgaaaacacttagtatgcagttgataagaggaatttgg

SEQ ID NO: 50841 - DNA, 385 bp, Homo sapiens
  misc_feature 32, 353: n = A,T,C or G
tatcaagaacgtcctaaaacacctatggcttngactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaagggctacattttcagtgtaagataaatggatgagtaaactcaaatatgtatcacgtgtgctttgnatcttaagatgggttccaagagcatctggaaa

SEQ ID NO: 50842 - DNA, 411 bp, Homo sapiens
  misc_feature 25, 84, 140, 162, 279: n = A,T,C or G
tatcaaattgatagtaacaacagangcataattttaggaaggctttcgcaagacctagccttttaagagaggtttttaacctgnagcatgagaatatatcacctgtggtttttcctttgagatgaaacgtagtttctagntatatcattacttaaagggctnaaaaagaaaaaacttagcaaacttttgaatctttcttttattgctatttacacatacatacacacatacaaaacctttaaattttgggatctgaatataattctggtaaacagctgncttcatttttctcctctaaagaacttaattcatttgtacataaaatataaggaaatctttatactatttacagtaccacaatctaaatatttacatatacccaaaattacttatgctcatatattaaggatg

SEQ ID NO: 50843 - DNA, 308 bp, Homo sapiens
  misc_feature 220, 231, 241: n = A,T,C or G
accacagaaaaacacactgcctgatctctctcttaagactagcatagcatatagttagtctatatagggctctctatggggcactagaaaacgtgtgtgtccaatcataaaagcatgtgctgtgtgtagatatgagaaggacataatgtctccctccagccttaaaaattaaatatgaaatagccgggtgcagtgactcatgcctggaatcccagcactntgggaggctgnggcgagtggncccctgatgcaggagctcgagcccgcctggcccacatggggaaatccctcttttctaaaaaaaaaaa

SEQ ID NO: 50844 - DNA, 301 bp, Homo sapiens
agagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctttgatgaataaaaagttttgtaaaacaagcttaagaatccaaat

SEQ ID NO: 50845 - DNA, 119 bp, Homo sapiens
ggcatgatcttcagtatgatcttgtgctgtgctatccgcaggaaccgcgagatggtctagagtcagcttacatccctgagcaggaaagtttacccatgaagattggtgggattttttgc

SEQ ID NO: 50846 - DNA, 257 bp, Homo sapiens
  misc_feature 234: n = A,T,C or G
gagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtgggttggcttgggaacaggactttatacctcttttactgtaacaagnactcattaaaggaaattgaatgg

SEQ ID NO: 50847 - DNA, 341 bp, Homo sapiens
  misc_feature 279: n = A,T,C or G
ctaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaattcttcaggttgaattacctagaagttgncactgacttgtgttcctgactatgacacatgaatatgtgggctaaagaaataagtccgcttg

SEQ ID NO: 50848 - DNA, 315 bp, Homo sapiens
  misc_feature 23: n = A,T,C or G
aatccagaggaacaaagcatgtntctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgtctgcttcgaagtattcaataccgtcagtattttaaatgaagtgattctaagatttgggttgggatcaataggaaagcatatgcagccaaccaagatgcaaatggttt

SEQ ID NO: 50849 - DNA, 197 bp, Homo sapiens
  misc_feature 178, 190: n = A,T,C or G
aaatacatacttcgaggattgactctatataaggagcctggagaactctgttacacatatttttgacccatattatttacaatgcttgataattctacctttttagagcaagaatagtatctgctaatgtaagggcatctgtatttaactccttggaggcatgaatttctatcaaaangtctttgactgnaacagag

SEQ ID NO: 50850 - DNA, 193 bp, Homo sapiens
  misc_feature 32, 73, 99, 105, 122: n = A,T,C or G
agcacgaggaaaccggcagacaagatgttttntctttgaaagatagaaagtaatacaactacgcaaaaaatanaggcaatagggtactaagatattgcntagcgngaagttattaacgtaantttaatagcttaagattttaagagaaaatatgaagacttagaagagtagcatgaggaaaaaaaaaaaaaaa

SEQ ID NO: 50851 - DNA, 126 bp, Homo sapiens
  misc_feature 51, 54, 62, 105, 109: n = A,T,C or G
accgggaaaaccaggaagaaaagcggggaaagaaaggacagcagactctgnaangaacgggnaccggagggaagaaacaggaggcagaaagaagacagggattanagcnaggaagaaagagaacgg

SEQ ID NO: 50852 - DNA, 293 bp, Homo sapiens
  misc_feature 85, 143, 238: n = A,T,C or G
ccccctctttgtatttattggaactggagctactggagcaacactgtatctcttgcgtctggcattgttcaatccagatgtttgntgggacagaaataacccagagccctggaacaaactgggtcccaatgatcaatacaagntctactcagtgaatgtggattacagcaagctgaagaaggaacgtccagatttctaaatgaaatgtttcactataacgctgctttagaatgaaggncttccagaagccacatccgcacaattttccacttaaccaggaaatatttctcctt

SEQ ID NO: 50853 - DNA, 284 bp, Homo sapiens
  misc_feature 168, 184, 193, 260: n = A,T,C or G
gacagcaaaaatgacccgccaatggaagcagctggcttcactgctcaggtgattatcctgaaccatccaggccaaataagcgccggctatgcccctgtattggattgccacacggtcacattgcatgcaagtttgctgactgaaggaaaagattgatcgcggtctggnaaaaagctggaaaganggcctaaantcttgaaggctggggatgctgcaatggtgatatggatcctggaagccatggggggtgagagcttctnagaccatccaccttggggcggttt

SEQ ID NO: 50854 - DNA, 247 bp, Homo sapiens
  misc_feature 76, 81, 103, 116, 120, 129, 143, 156: n = A,T,C or G
ccaaaatcaacttttaattggctttgagaagtttgagttaatgattttgaattgcccatgtttgtatttttttttngtttncaccctagaaattcctattctnggccaggcgcatngacncacacctgnaatcccagcacttngggaggccgaggngggagaatcgcttgagcccaagagttcgagaccaccctgggcaataaagtgagaccccatctctaccaaaaataaacattaaaaaaataag

SEQ ID NO: 50855 - DNA, 239 bp, Homo sapiens
atcccatcttgcaggacgacattgaagaccggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttcttatgtga

SEQ ID NO: 50856 - DNA, 365 bp, Homo sapiens
  misc_feature 15: n = A,T,C or G
tatctagccattttnctttgcaaattacataccttcttaagagtgtatttttaagattattacttatgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgtctcatgacacccaaaattggatgagagcaaaggggtcgcaccatatggaaatgttgaaaactattgtaaagtag

SEQ ID NO: 50857 - DNA, 334 bp, Homo sapiens
  misc_feature 27: n = A,T,C or G
atctctcctttccaggcggagacctcngccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcaagtgaatgtggattacaagcaagctgaagaaggaacgtcagatttctaaatgaaatgtttcactataacgctgctttagaatgaaggcttcagaagccac

SEQ ID NO: 50858 - DNA, 258 bp, Homo sapiens
  misc_feature 209, 211: n = A,T,C or G
gttttcttttcaaagaagcatctgaacacttgcatttctattttcctatccaaaggcatccacatctaagtgtgtttttaaagttgattaaaattatttttctgttaaagcattctgaaagtgtttgctttacctagaatgatttgacacactcgtggcaactgaacatgaatgtcaagtagtagtctaattatgggaagggtaaacgngntagattaaggctcttaaagctctaaaccatataaactatggacttgg

SEQ ID NO: 50859 - DNA, 409 bp, Homo sapiens
  misc_feature 31, 61, 378: n = A,T,C or G
gtaaataagttgatggtggatggtgggtttnaggtttctctctatttgagtaggatttacntgataagcaaggggaggcagctagaagaaatcatgcagtaatgcattagagttggaaaccagaatgaactcatgctttgcttatagacacagttacatatggaaatacttatcgataagggaataggcaaatgttagtatacaccgtatatttccttgctctcagaaaagagggcctagaagcaacaacaccccagtagatgaatgtacccacttgccagatcttgatttctaagaccattctccagtaaaaaggaactaaggctccttggagaaatggatgattctaaaagggctggggcaggaaatacacaaagngagcatggggcatcttgcagtgctagaaagg

SEQ ID NO: 50860 - DNA, 375 bp, Homo sapiens
  misc_feature 31, 42, 43, 365: n = A,T,C or G
aatcacaagtcattagtagggttatgggagngttttttgcannataatgataaaccaaccacagactaaacccagtaaaaactttgtaacatgtccttataccgacacattctgttgttttcatcctttttcctctttatttttctggatattatcatcttacatctcctagaagtttcattcagaatttaagtatcagacaggtttatagggcattcggataatataagcagagaacaaattatttgcaggttcaatatggaaattcttaaattatagaaagaatatgtattctaatgaaagttgggatgaaatacaggagaatctcatcaataaatgtgaggtaatatacacatacttaattnacacaaattt

SEQ ID NO: 50861 - DNA, 317 bp, Homo sapiens
  misc_feature 27, 88, 154, 163, 247, 250, 264: n = A,T,C or G
ggagcaccccatcatataaaaaacttnaattatatttaaacagtaagtctttggattgttttgccttttaatttccatattacataanaatgagataaacattaatgttttcagggtactttaaattttagataattactcattgtattcatgngaaatttgnttttactgcatgtgcgggttggagggcgggttttcacttctgattcatctttactcttatctcatcagagctcatacctcttgnagntgggggattgcagnttataattccaataaatgggggcaaattcaataataacataatacaaatgagt

SEQ ID NO: 50862 - DNA, 359 bp, Homo sapiens
  misc_feature 18, 53, 228: n = A,T,C or G
cagaggaacaagcatgtntctctgccaagatccatctaaactggagtgatgcnagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgncagtattttaaatgaagtgattctaagatttggtttgggatcaataggaaagcatatgcagccaaccaagatgcaaatgttttgaaatgatatgaccaaaattttaagtagggaaagcacccaaacacttc

SEQ ID NO: 50863 - DNA, 394 bp, Homo sapiens
  misc_feature 51, 84: n = A,T,C or G
atgaaactgatggtactttttttcaccattgggctaactttgctgctagtnttcaaaccatgcctgcaaatcgcctctcttgcnacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttccacaaactgcactacatcagtataactgcatttctaggtttctatatagtgcaatagag

SEQ ID NO: 50864 - DNA, 313 bp, Homo sapiens
gacatctgacgacgtgaaggagcagatttacaaactggccaagaagggccttactccttcacagatcggtgtaatcctgagagattcacatggtgttgcacaagtaccgttttgtgacaggcaataaaattttaagaattcttaagtctaagggacttgctcctgatcttcctgaagatctctaccatttaattaagaaagcagttgctgttcgaaagcatcttgagaggaacaagaaaggataaggatgctaaattccgtctggattctaatagagagccggattcaccggttggctcgatattataagacc

SEQ ID NO: 50865 - DNA, 346 bp, Homo sapiens
  misc_feature 38, 45: n = A,T,C or G
cttaaatgctacccagcatcttaaaccagcttggtgcnggatagnctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctctt

SEQ ID NO: 50866 - DNA, 366 bp, Homo sapiens
  misc_feature 21, 128: n = A,T,C or G
taacgaaagcagggacaagtnttgtaaggattcaaaccatttgccaaaaatgagaccaagtgcatttactctgttcctggcattgattggtggtaccagtggccagtactatgattatgattttcccntatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcaggggctcattctaagatcacaaccttctagaaaactcca

SEQ ID NO: 50867 - DNA, 276 bp, Homo sapiens
  misc_feature 39: n = A,T,C or G
acttcaaagatgttaacagtattttaagaagttgctgcngattcctttggccactgtatttgttaatttcttgcaatttgaaggtaccgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaagttggtattttataagccagacaattctaatggtaacttttg

SEQ ID NO: 50868 - DNA, 350 bp, Homo sapiens
  misc_feature 22, 319: n = A,T,C or G
agtagctcaagttatttaaatntgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttaagcggctcactgacctgcctgtagccccagngacagctaggatggcattctccagccatcaa

SEQ ID NO: 50869 - DNA, 336 bp, Homo sapiens
  misc_feature 28: n = A,T,C or G
taacaaaactaggctgtcccgaaccccnggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagcagaaagctaaataaaaaaatgaaacttttttgagtaataaaaatgaa

SEQ ID NO: 50870 - DNA, 339 bp, Homo sapiens
ggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtctgggcagaccttatccaaagtctggtacaactgtccttagactgatgagcaaaggaggagcaactaatgaagaaatgaataataaattt

SEQ ID NO: 50871 - DNA, 376 bp, Homo sapiens
  misc_feature 31, 312, 344: n = A,T,C or G
actaacttccatggcatggatcttacccgtnacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgncaatctatttatcctctccatgatgtcttcgntaagaaaagtaaaaatgctgaagaagcccaag

SEQ ID NO: 50872 - DNA, 211 bp, Homo sapiens
  misc_feature 30, 35, 53, 58, 87: n = A,T,C or G
ttttatctgagcctggaatttctgccttcngcacnactgaaacccatggtttncagcnaagttatactcctaagatgagggaaatanatccttagttttttgtgaagtaatactgtctgacacttctaaaagaagcttcatgaggtaaccatgctattggcaagaatggtgtgaatgtgagaaaattgccccgagatgctatattttaagg

SEQ ID NO: 50873 - DNA, 357 bp, Homo sapiens
  misc_feature 14, 50: n = A,T,C or G
acaagccatgaagntttcaccaaggccatgggcaccatgaacagacagcngaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctg

SEQ ID NO: 50874 - DNA, 170 bp, Homo sapiens
  misc_feature 36: n = A,T,C or G
tgtttacaagaactggttgattctgggaggcatctngctacagtctctttttatatggatatgtacatgtcctattctacaaaaatgattaaagataaaaacatacttgtatcccactgctactttagctgtcaaatttggtgtttcatcacattaaaagaaaaaaaaaa

SEQ ID NO: 50875 - DNA, 160 bp, Homo sapiens
agatgctctatagtcttttccatacaactgttgacattcaattaaagaaatatgaaacaggactaaggaaacaacaacagacagtagtagtagatgcataaatgaccagttattaggaattaacggatatacatatttaaataactataacaaacataaa

SEQ ID NO: 50876 - DNA, 390 bp, Homo sapiens
  misc_feature 16: n = A,T,C or G
gagcaattactactcnttctgggcagaccttatccaaagtctggtacatctgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggtcacacctgtaaaagaaaaaagaatcaaattgaatatatcttttaagaattcaaaactagtgtattcacttaccctagtcattataaaaa

SEQ ID NO: 50877 - DNA, 337 bp, Homo sapiens
  misc_feature 22, 39, 324: n = A,T,C or G
tagtgttaacccgagaatacancatcaacattcacaagngcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggcttgtccagaaaacgtaatgaggatgaagattcaccaaataagctatatactttgggtacctatgtacctgttaccactttcaaaaatctacagacagcaatgtggaggagaactaancgctgatcgtaga

SEQ ID NO: 50878 - DNA, 142 bp, Homo sapiens
agccaaagactgtaaatatttatttatgtgttcacatggtcaaaatttcaccactgaaaccctgcacttagctagaacctcatttttaaagattaacaacaggaaataaattgtaaaaaaggttttctgtaaaaaaaaaaag

SEQ ID NO: 50879 - DNA, 148 bp, Homo sapiens
  misc_feature 32: n = A,T,C or G
tctttgaaagatagagattaatacaactactnaaaaaatatagtcaataggttactaagatattgcttagcgttaagtttttaacgtaattttaatagcttaagattttaagagaaaatatgaagacttagaagagtagcatgagagg

SEQ ID NO: 50880 - DNA, 382 bp, Homo sapiens
  misc_feature 21, 87: n = A,T,C or G
tttcataccaggggatggtanttcgtgtaacttgcaatagattccttcatcttagtaataagatgatcagtctagttaggacaaaanagagattgaataaattaacttttccaagtttacagagtaaagatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtcaatgtgatggcatttattattcagataatcccaggattctagaagaaaataaagaagagtgacagttcagtta

SEQ ID NO: 50881 - DNA, 100 bp, Homo sapiens
  misc_feature 23: n = A,T,C or G
actttatctgatttgcactcatnactgattccatatttattcactgccctgactcggaactcatactgaccattggggataagtttccagatctaaaaaa

SEQ ID NO: 50882 - DNA, 345 bp, Homo sapiens
  misc_feature 29, 31, 51, 63, 243, 270: n = A,T,C or G
gagagagcgagcgagagagatttccttgntntttctcccaagggcgaaagncattggaatttncaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggntgcctctgaagaaactgccttcattgnatatatgtgactatttacatgtaatcaacatgggaactttaggggaacctaataagaaatcccaattttcaggag

SEQ ID NO: 50883 - DNA, 377 bp, Homo sapiens
  misc_feature 36, 37, 39, 72: n = A,T,C or G
gctctttacgtgctataggaccttctcaaacacacnntntcagaattcaatattcacctgccagactggctnatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttggcactgaaaaaaaaaaa

SEQ ID NO: 50884 - DNA, 278 bp, Homo sapiens
  misc_feature 265: n = A,T,C or G
tggagatttgatgagaagagaaattccatggagccaggctttcccaagcaaatagctgaagactttccagggattgactcaaagattgatgctgcttttgaagaatttggggatcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattctncacctaagtctct

SEQ ID NO: 50885 - DNA, 170 bp, Homo sapiens
  misc_feature 17, 31: n = A,T,C or G
tgttaatgtctatcttntgtctctttaaccntgtatatctgctgttttgcttttggatacattttctaattagaagtcacatgataaatataatcagtatagtaataataccataatgtgcacatactcaataaataaatgactgcattgttgtaaaaaaaaaaaaaaaa

SEQ ID NO: 50886 - DNA, 388 bp, Homo sapiens
atatacaatagccttcattttgagaggataaattcaccctcctcaaatagttgtaaatagtccattgctcactaggaatgagcaaaaagaaaaataaacaggcatgatcaagtaccgaggttttgaatagttaggaattagatactttcacgtagtgttagaattaggtactgaaacctcctgagttatgagaaattgaatggctctgaatgattaagagctgctgtatctatgttgtatggattttgacacatggtatttataaaatttacacaaatatgttacaaaatggaaaagatgttgctatccactatgtgcaaacatttgggcacacgtgtgtgattcatatcaaaagctgttccatacccagctcatctgcagcttacta

SEQ ID NO: 50887 - DNA, 360 bp, Homo sapiens
  misc_feature 76, 80, 81: n = A,T,C or G
tcgatgaacactttttgcgagccgtcggaccctgagcaggagacttgaaccaacatgctgctggagctcgcaaggncacnnttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgcatcaccttttccattccagctgcattctgccctggctaagcaagacaaattcctgtcccttgtgccgctatgagctgcccactgatgacg

SEQ ID NO: 50888 - DNA, 322 bp, Homo sapiens
  misc_feature 14, 22, 41, 152, 214: n = A,T,C or G
aataattcaattcntataggcncgctgtaagaacttagtcntatttgacttttttattttatgttaatgttttcagttctcactttgaggcacatttacatcaatgcttttgttcctctcacatgctgaaagcaagatgtgttccttattgngaagagcgacacaactgcctgctgctttccacagctataatggacatcaggtgactctaaancaaggatcatgtgtgcacaatacttgtggccacaaaatttcacaatgactgctgaggaatcattctttttgcctgtaaaatataacaaagggcatcattaagtagacc

SEQ ID NO: 50889 - DNA, 386 bp, Homo sapiens
  misc_feature 86, 87, 355: n = A,T,C or G
cttctgctgagggggcattttggagcttgaggaaaccgcagataagtttttttctctttgaaagatagagattaatacaactactnnaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggngacttaaacagctaaaggttagttaaaaagt

SEQ ID NO: 50890 - DNA, 391 bp, Homo sapiens
  misc_feature 22, 54, 86: n = A,T,C or G
cttctgctgagggggcattttngagcttgaggaaaccgcagataagtttttttntctttgaaagatagagattaatacaactactnaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaagattaaaatgaaggtgacttaaacagcttaaagtttagttaaaaagttg

SEQ ID NO: 50891 - DNA, 332 bp, Homo sapiens
  misc_feature 36, 298: n = A,T,C or G
aatattcttgctttcaatcaatttatactgagccgnaactttaggatttctgctattaaatgcatgctctctatcctgcttcagtttctggctttgctttgtctgtttcaaaatatgtagcttcctcttttgtacaacaaaaaactcattctcactttactaaatatactgtaggagcatcattgatggtatttttctcttatgtatctgtaaagatttttggcatatgaatgtaatattaaagtcaatgatgctataacttgcgatggttgcatcatgtcaacctttttgaaggagngaaaaagccctactatgtttttaaatagcaaggg

SEQ ID NO: 50892 - DNA, 339 bp, Homo sapiens
  misc_feature 90, 207, 241, 242, 253, 258: n = A,T,C or G
tgtctgacaaacccgatatggctgagatcgagaaacccgataagtcgaaactgaagaagacagagacgcaagagaaaaatccactgcctnccaaagaaacgattgaacaggagaagcaagcaggcgaatcgtaatgaggcgtgcgccgccaatatgcactgtacattccacaagcattgccttcttattttacttcttttagctgtntaactttgtaagatgcaaagaggttggatcaagnntaaatgactgngctgnccctttcacatcaaagaactactgacaacgaaggccgcgcctgctttcccatctgtctatctatcttggctggcagggaaa

SEQ ID NO: 50893 - DNA, 179 bp, Homo sapiens
ataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccagaa

SEQ ID NO: 50894 - DNA, 335 bp, Homo sapiens
tgacaaacccgatatggctgagatcgagaaaccgataagtcgaaactgaagaagacagaggcgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgcctttcccatctgtctatctatctggctggcaagggaagg

SEQ ID NO: 50895 - DNA, 329 bp, Homo sapiens
  misc_feature 316: n = A,T,C or G
ttagctacggcaatcctgaactccctgaagatgtccttgatgtgcagctggcattccttcgacttctctccagccgagcttcccagaacatcacatatcactgcaaaaataagcattgcatacatggatcaggccagtggaaatgtaaagaaggccctgaagctgatggggtcaaatgaaggtgaattcaaggctgaaggaaataagcaaattcacctacacagttctgggaggatggtgcacgaaacacactggggaatggagcaaaacagtcttttgaatatcgaacacgcaaggctgtgagactacctattgnagatattgcaccc

SEQ ID NO: 50896 - DNA, 250 bp, Homo sapiens
ttgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaaca

SEQ ID NO: 50897 - DNA, 189 bp, Homo sapiens
  misc_feature 29, 37, 67, 119, 122, 151, 156: n = A,T,C or G
gacaaaccaaaacattcaatagaaggggnggaagatnaagtcaagagactctcccagaaagtagaangaaaagaaagactcagaacatcagagaataaagacaaaataaagggtcaacnggnagatccaaaatttaactaagactgttttntagangaaagaatggaaaaacaaacaaacaaacatcct

SEQ ID NO: 50898 - DNA, 324 bp, Homo sapiens
  misc_feature 26, 49, 72, 106, 296: n = A,T,C or G
ttgatacaaaatatacttttaaactncataacctttttataaaagttgntgcagcaaaataatagcctcggntctatgcatatatggattagctataaaaaatgtnaataagattgtacaaggaaaattagagaaaggcacatttagggtttattttttacacttggcagtaaaatagggtaaatcctattagaattttttaaagaactttttttaagtttcctaaatctgtgtgtgtattgtgaagtggataagaaatgactttgaaccactttgcaattgtagattcccaacantaaaattgaagataaaaaaaaaaaaaaa

SEQ ID NO: 50899 - DNA, 194 bp, Homo sapiens
  misc_feature 16, 20, 61, 75, 105, 125, 146, 173, 177: n = A,T,C or G
aggaagtggcacacanctcngatgatgggaaccaggacacttcccttattacacaaggggncctactcctggccnagtgctaatgtaggccaatgatgccatgtngatattgggaaccataactnctcttaaccaagaagccagtntggtaggggttcaacagaaacatcatntgcnatgaccaggtgagagag

SEQ ID NO: 50900 - DNA, 312 bp, Homo sapiens
  misc_feature 27, 37, 109, 113, 127, 136, 173, 213, 221, 237, 269, 295,306: n = A,T,C or G
gcctcttgtaagccaccagacaaagcncttgagtggnagcaactgaaactgtgcggagcattctgaaaatagatgatgtggtaaacactcgataatctggataactgantagnaccattatgatcancagtattgnggctggaatggaagaagatcaccttggtgttccttgnttggaagattatttcctctgaatttctgggcttggtcttncagttggnattttgctgaagttgnattgaaacaattaatgaaaatattaaatattngggtttcaaaagggagatttatcttntcccaacattntggtat

SEQ ID NO: 50901 - DNA, 265 bp, Homo sapiens
  misc_feature 28, 44, 73, 93, 124, 211: n = A,T,C or G
aaatactttggcactgactacacaagcngatcaaaataaccctnggaaaaagatatgttgggggacacaaagnaagcctctttatgaaacaantgaggataatgatgtgaaagggtttaatgangatgggctacttcagatagttcactttctactgaatagaccaaaagaagaaaaatcacagctggtggaaaactgaaaaagcatattngattgagaactgggggaatatttaaattttactgaaggaacaataatgatgaga

SEQ ID NO: 50902 - DNA, 277 bp, Homo sapiens
  misc_feature 215, 258: n = A,T,C or G
gccgaagaaaattgaaatcagccagcacgccaagtacacttgctctttctgtggcaaaaccaagatgaagagacgagctgtggggatctggcactgtggttcctgcatgaagacagtggctggcggtgcctgggacgtacaataccacttccgctgtcacggtaaagtccgccatcagaagactgaaggagttgaaagaccagtagacgctcctntactctttgagacatcactggcctataataaatgggttaattnatgtacagagggagagggg

SEQ ID NO: 50903 - DNA, 141 bp, Homo sapiens
  misc_feature 12, 30, 57, 60: n = A,T,C or G
ggtaaaaactangaaacactgttgtacacnactgattttttaaaaaataaacacatnccnaaagatgttgaatttttccccccttattgggaattcttaaaaataaatgcatgcatgttttcccctgaaaaaaaaaaaaaa

SEQ ID NO: 50904 - DNA, 208 bp, Homo sapiens
  misc_feature 31, 34, 53, 136: n = A,T,C or G
tgcaggggatactagacttctagcaccgtgngtncgatcttattccctaactncatgttgctccgtgaacacggatgtgatggtcagagcatggcttgcaacctgaggatgagggcagccatgtcccagggatggnagtgcaatgagctagaaggatgtgagttcctaaggactccatggagccacctcactagcccagtcctggaga

SEQ ID NO: 50905 - DNA, 332 bp, Homo sapiens
  misc_feature 23: n = A,T,C or G
ttggaggatgcactgggcctgcngcggaacagggcatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgggtgatgtatttgaatgtctgttatttccagc

SEQ ID NO: 50906 - DNA, 169 bp, Homo sapiens
tttatgtttttaagtagtcaaacttcaagaaacaacctaaacaagtttctgttgcatatgtgtttgtgaacttgtatttgtatttagtaggcttctatattgcatttaacttgtttttgtaactcctgattcttccttttcggatactattgatgaataaagaaattaa

SEQ ID NO: 50907 - DNA, 245 bp, Homo sapiens
  misc_feature 19, 40, 70, 111, 113, 119, 154, 160, 165: n = A,T,C or G
aatataaatatcatacctnctatatatatataaaattatnaaaaagactgagttataatacatgaagagnaggaaaaaatagttgcactgagttttatattttctgaatgntnaaatcnttccacacaatatgtaataattatacttttaaaangccagnaaggnaatatatacaaatagctaattaaagcttaataagaactttggaaaaatatttttaataaagggtttacatacatcagggg

SEQ ID NO: 50908 - DNA, 305 bp, Homo sapiens
  misc_feature 9, 20, 252: n = A,T,C or G
ggcactagnacagcactgtngcaaagtatttaagcaccccccatctcagccctttattttatcttgcatgtgggctaatgtgaggataatcttacagatattataggaatttcttttctatctttatgaaaacaacgtatataaaatatatctagaaaacctttgtttgagactcttatttaatgggcttttgattctaatgataattgacctttatctttcaaaagctgatatttcctacctaagcatctnccgagaaaaatatctcattaaaaagcccataaataataggggagaagaaagct

SEQ ID NO: 50909 - DNA, 240 bp, Homo sapiens
caaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtata

SEQ ID NO: 50910 - DNA, 318 bp, Homo sapiens
  misc_feature 22, 57, 62, 65, 79, 214, 230, 270, 295: n = A,T,C or G
tactgcggggagacaaaagacngaggagagcaccgaagaagagaaaatagaaggggngcatngancagaaaactgctgnaagacaagcaagaagggagacctactaaatgcccattatgacggctacctggctaaagacggctcgaaattctactgcagataaacctctacttgcaaagggaatttgaaaaagatgagaagccacgtgacaagnatatcaggatgcaagntttagaagatatttttaagaagaatgaccatgatgggganggcttcatttctcccaaggaatacnatggataccaacacgatgaacta

SEQ ID NO: 50911 - DNA, 282 bp, Homo sapiens
  misc_feature 274: n = A,T,C or G
ttaagccctttgctctggaggaagttctccagcttcagctcaactcacagcttctccaagcatcaccctgggagtttcctgagggttttctcataaatgagggctgcacattgcctgttctgcttcgatgtattcaataccgctcagtattttaaatgaagtgattctaagatttggttgggatcaataggaaagcatatgcagccaaccaagatgcaaatgttttgaaatgatatgaccaaaattttaagtaggaaagtcacccaaacacttntgctttca

SEQ ID NO: 50912 - DNA, 141 bp, Homo sapiens
aatctagaagatagagtggtttcttagaactttgtaaaattttggttagaaatatttcagttaactgcagttttttcctagctattcggtcagcagaaaaagtttgcttaaaacaaaggggggagtcctcttataacctga

SEQ ID NO: 50913 - DNA, 160 bp, Homo sapiens
  misc_feature 79, 94, 112: n = A,T,C or G
aacgcaaaggaacaaggacattctttagctggaacctaactaatgaaaggggcctttaccacacgccatttaaataagncccaattttttcttntttgccatttgggaagcnttgcccattggggcttaaatggcacatgggggagggacaccgggatct

SEQ ID NO: 50914 - DNA, 131 bp, Homo sapiens
caacttacctcccttctctaagcccaagcctgcccctgggcacagcctcgcacaaaccacattggcctggtggggcccagggactggaaataaagtcgttccgataagacacggaagataaaaaaaaaaag

SEQ ID NO: 50915 - DNA, 278 bp, Homo sapiens
  misc_feature 213: n = A,T,C or G
ggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgnggatggaaatgagaagcattctaaatttgagttaatatatttttatgaagatatttgaaaaaaaa

SEQ ID NO: 50916 - DNA, 322 bp, Homo sapiens
  misc_feature 21: n = A,T,C or G
tgacaagaaatttattctgtnttagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatgctttatctaaaagaatgacgctcgggaaagccttg

SEQ ID NO: 50917 - DNA, 238 bp, Homo sapiens
  misc_feature 23, 52, 58: n = A,T,C or G
caaagaaacaagcgaaggggagnaaatagaacctataggcaccctcctcagngcgggngggctgagagttaaagacagtgtggctgcagtagcatagaggcgcctagaaattccacttgcaccggagggcatgctgataccatcccaatagctgttgcccattgacctctagtggggagtttctagaatactggccattcatgagatattcaagattcaagagtatctcacttctggg

SEQ ID NO: 50918 - DNA, 162 bp, Homo sapiens
  misc_feature 86: n = A,T,C or G
ccacaagcattgccttctgattttacttcttttagctgtttaactttgtaagatgcaaagaggttggatcaagtttaaatgactgngctgccctttcacatcaaagaactactgacaacgaaggccgggctgcctttcccatctgtctatctatctggctga

SEQ ID NO: 50919 - DNA, 214 bp, Homo sapiens
  misc_feature 161, 185: n = A,T,C or G
aaagccaacaagcccagattaaacaggctgtgaagaagctggatgacattggatgtggccaagggcaacaccctgattcggcctgatggagagaagaaggcatatggtcgactggctcctgattacgaagctgtggatgttgccaacaaaattgggatcanccaaactgagtccagctgcctaantccgaatatatatatatatatatatcttc

SEQ ID NO: 50920 - DNA, 154 bp, Homo sapiens
  misc_feature 106: n = A,T,C or G
tggaaggagtcaaacgggcgggaatcccgcagataatctgcagggctgtggtttccagcaagacccaaagctagaaaaggaggaggaagaaactgacccgatcagngccagaagtcattgtattcaaagaagaataagctaaataaaaaaaaaa

SEQ ID NO: 50921 - DNA, 137 bp, Homo sapiens
ttatgccacaacgaactggctgacgagtggaatacctggaaatgctttcaatgagacatggctgggtgagctggggctgcctatcacgagcttaagaacataccaactgggaaatggaaaaccccgaaactattacc

SEQ ID NO: 50922 - DNA, 237 bp, Homo sapiens
  misc_feature 11, 51, 67, 71: n = A,T,C or G
ccccctgaaancagggacatggcaagaatgcctactttcgccacctctatncagcattattctgtgngttntaggtaggacaattaggtaaggacacaaaaagacaaccaaattggaaaggaagacataatgcttacttcctttcacagatggcatgatatacataaagtaaaacgaagaattttttaaatgattaaaaataaattcaccagagttgcaggatacatggttaacatg

SEQ ID NO: 50923 - DNA, 106 bp, Homo sapiens
  misc_feature 63, 67, 69: n = A,T,C or G
tggacattggggacttgactgggggaagaagaaggttgcatggctctaggacggacatgttgncatngntgggataagacgaactaacaaacccctttgggtgccc

SEQ ID NO: 50924 - DNA, 204 bp, Homo sapiens
attgcctagaaacaacttgcttttacctgttatttatcaattctgcccagtatttccatacggaaaaaattgtattgaaaacacttagtatgcagttgataagaggaatttggtataattatggtgggtgattattttttatactgtatgtgccaaagctttactactgtggaaagacaactgttttaataaaagatttacaag

SEQ ID NO: 50925 - DNA, 144 bp, Homo sapiens
  misc_feature 98: n = A,T,C or G
ttacctgtcacaaatcaaaggggcccagcagctccacacagaaaaaagcgtaccgaaaagaccgagtacgcagccgataagaggaatgtggtagaacnagggtgggggaggaagccatgctaccgcttgggactgagggagaaa

SEQ ID NO: 50926 - DNA, 238 bp, Homo sapiens
  misc_feature 23, 77, 102, 176, 199, 214: n = A,T,C or G
ttagagacaatcagtatgtgctnacctgtgttcaagcagagaaaaatacagtagagtctgataggacatattcttgnaccacagacaaaacaaatcttatgntgcatttactatcaactgctgctaatacggtattataaaacttacctagctcctgaatcttcctatcttatagnctaaaaaaattaggacataggcnaatcaggtaccctgnagaaagagccttggatgacagaca

SEQ ID NO: 50927 - DNA, 107 bp, Homo sapiens
gattcatgtattgggaagctacagggactacgtaatacctgcttatcacataggaaaattatgtccatgattctgagctcccttcttcaaaagtttcctcctgggtg

SEQ ID NO: 50928 - DNA, 300 bp, Homo sapiens
ttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaaataaataaaagctagatactggaaacctaactgcaatgtggatgttttacccacatgacttattatgcataaagccaaatttccagtttaagtaattgtctacaataaaaagaaattttgcctgccattttcagaatcatctt

SEQ ID NO: 50929 - DNA, 130 bp, Homo sapiens
ttcaccatgctggccaggctggtctcgaactcccgacctcaggcgatccaccagcctcagcctcccaaagtgctaggattacaggtgtgagccaccacacccggccgtcttcacagatttaaacatgaac

SEQ ID NO: 50930 - DNA, 330 bp, Homo sapiens
cagaatatattttaaaaaacacttctaaaaatcataataaagacaatataataaaaaatggtcacagacttaaaaacaagataaacaaatggccaaaaagcacatgaaaagatgctcaacatcatgagtcattatggaaatagaaatttaaaacgctgtgggataccactatatactcaatacaatgagtaaagttaagactgaaaacaccaagtattggcaaggatgtggtgcatctgaaactgtcatacattattgatgggaatgtgtaacagtacaaccactttggaagataatgtcttgtatagttaaacatgtacctatcctgtg

SEQ ID NO: 50931 - DNA, 400 bp, Homo sapiens
  misc_feature 26, 42, 52, 62: n = A,T,C or G
atgacaacaaattttgtaattgatgntgtagataaactcctntatccagcanacacacctgntggaaatgatcaactgctggaaatacttaataaattaatcaaatacatccaaattaagtttgtccgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccatgaggaagttgcaagccaacaaaaaagtcaaggatctagaagacgattaagggaagg

SEQ ID NO: 50932 - DNA, 306 bp, Homo sapiens
  misc_feature 40, 76, 85, 118, 126, 141, 155, 193, 199: n = A,T,C or G
tgtgctcacacagtcagtcaagaacaatacccaagtgctnatcaactgccgcaacaataagaaactcctgggccgngagaaggcnttcgataggcactgcaacatggtgctggagaangtgaaggngatgtggactgaggnacccaagagtggcnagggcaagaagaagtccaagccagtcaacaaagaccgntacatntgcaagatgttcctgcgcggggactcagtcatcgtggtcctgcggaacccgctcatcgccggcaagtagggccgcctgtcttgttgacagaactcacttcctctgtc

SEQ ID NO: 50933 - DNA, 259 bp, Homo sapiens
  misc_feature 11, 41: n = A,T,C or G
agaaagatganttaatccttgaaggaaatgacattgagctnggttcaaattcagcggctttgattcagcaagccacaacagttaaaaacaaggatatcaggaaatttttggatggtatctatgtctctgaaaaaggaactgttcagcaggctgatggataagatctaagagttacctggctacagaaagaagatgccagatgacacttaagacctacttgtgatatttaaatgatgcaataaaagacctattgatttgg

SEQ ID NO: 50934 - DNA, 352 bp, Homo sapiens
  misc_feature 12, 144: n = A,T,C or G
tcccgaagtttngccaaaacctcggatgcggggccttctggccaggcgctgccgaaatcatatggctgtagcattcgtgctatgcatgggggttgcaagctttgtataagtttcgtgtggctgatcaaagaaagaaggcatacncagatttctacagaaactacgatgtcatgaaagattttgaggagatgagggaggctgatatctttcagagtgtaaagtaatcttggaatataaagaatttcttcaggttgaattacctagaagtttgtcactgacttgtgttcctgaactatgacacatgaatatgtgggctaagaaatagttcctcttggataaataaacaattaat

SEQ ID NO: 50935 - DNA, 347 bp, Homo sapiens
ccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaa

SEQ ID NO: 50936 - DNA, 380 bp, Homo sapiens
gtgcagccacaccaggactgtgttgaagggtgttttttttcttttaaatgtaatacctcctcatcttttcttcttacacagtgtctgagaacatttacattatagataagtagtacatggtggataacttctacttttgggaggactactctcttctgacagtcctagactggtcttctacactaagacaccatgaaggagtatgtgctcctattattcctggctttgtgctctgcaaacccttctttagcccttcacacatcgcactgaagaatatgatgctgaaggatatggaagacacagatgatgatgatgatgatgatgatgatgatgatgatgatgaggacaactctttttttccaacaaggagagccaagaag

SEQ ID NO: 50937 - DNA, 299 bp, Homo sapiens
  misc_feature 207, 288: n = A,T,C or G
ctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgntgctaacgaagcactcttaattaatatctgtatcctggacaatattttatgggtatgttttctgggggcagttttcatagnatccatattta

SEQ ID NO: 50938 - DNA, 348 bp, Homo sapiens
  misc_feature 324: n = A,T,C or G
ggaactctaaacaagaaaaaaaaacaggtgatctcattaaaaagtgggcaaatggcatgaatagaaatttctcaaaagaattgatataaatggtcaagaaacataaaaaaagtacaacagatctaatcattagagaaatgcaaattaaaaccacaatgagataccaccttacccaaagcagaatggctattaataaaaattaaaaaaaatagatgttggtttggatgtggtgaagaaggaatatttatatactgctgatgggaatgtaaattagtacaatgtctatagaaaacagtttggagatttttcaaagacatcaaagtngacctccatttgatccagtaattt

SEQ ID NO: 50939 - DNA, 312 bp, Homo sapiens
agagcatagaacttatcccaatcagatttgatggatgaatgaaaggaagaaaactgactgttcttagtgtttgctggaaagaggaaaaccatgagcaatgggataaattaaacatttcagttgaataaatgtttaccaaattgctaataaagaataggctctgtacttggccttgggcaaacaatagtgtaaaatatacagtctgccctctagttgcttattggagtgagcatagtacattctgataaatgtacaagagctagaatccagaacatagaattttccttgtggatttgtttaaaaaaaaaaaaa

SEQ ID NO: 50940 - DNA, 110 bp, Homo sapiens
tgtcaacttgaagttaccaagttttaaccactgttagaaaataagcaggaatgaaatctgtttcaagcgtttcaatttcaatacaatttaataaacaggctttgagcatc

SEQ ID NO: 50941 - DNA, 419 bp, Homo sapiens
taccaagacctgctcaatgttaagatgttccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaa

SEQ ID NO: 50942 - DNA, 355 bp, Homo sapiens
gtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgcaaacccttctttagcccttcacacatcgactgaagaatatgatgctgaaggatatggaagacacagatgatgatgatgatgatgatgaatgatgatg

SEQ ID NO: 50943 - DNA, 351 bp, Homo sapiens
cacagttccagcttcccccaatcacttctaaacagtgactgcagccttgtttagaatcactatgaaaacctgcaccccggctgactactgggatccataagggggccgtgtcaaagggactaactagtggactccatcagtaggccctggaattcaggattgttcacatcctcttggtgccaaggacctggctgaagaccagctcttctgatccagaggttttcagcaaacagcatttgaaacaaaagcacagctgctctgtttgacaccaaactgtggctccagattccagtagaagccaaatgctttttcttttacaggctaggggcctgtaatcccagttacttggga

SEQ ID NO: 50944 - DNA, 360 bp, Homo sapiens
  misc_feature 148: n = A,T,C or G
gtttttgcagttaacgcataaggctggaccctatttcccgaatgcaggggtaacccttctgttatttaaagatgtaaaaaaatgcgggagacttgagaagaaaggccatggaaggcaccatcgatggatcactgataaatcctacagngattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttgggtatctcagcaaatgacacttcaattctaattgttacattgaagaggggagaaaaacaaata

SEQ ID NO: 50945 - DNA, 310 bp, Homo sapiens
  misc_feature 20: n = A,T,C or G
ctgttttggggaagaaggtncgcgctaaatgcaacacgggatgataccatcggtgaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgcc

SEQ ID NO: 50946 - DNA, 367 bp, Homo sapiens
  misc_feature 70, 140: n = A,T,C or G
agagacatgcttaaaaagatgagagaaacatattttttcaggaaaaacaaactttaaaaaaaaaagaggngaaataaaaccttttctcccctttccccatcctctatctatccctctttcccaggaacaaatcaaaaggnggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggtttgtattcagaatgttgtgcaatattttggaatgggacat

SEQ ID NO: 50947 - DNA, 210 bp, Homo sapiens
  misc_feature 151: n = A,T,C or G
cctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgnatttttgaataaaaaacatttgtacattcctgatactgggtacaagagccatgtaccag

SEQ ID NO: 50948 - DNA, 393 bp, Homo sapiens
acgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgacctttgcctggaatgtgtccccatctctactctaagaaatgcgcaatggactctttggagaaagaagatattttaat

SEQ ID NO: 50949 - DNA, 277 bp, Homo sapiens
  misc_feature 35: n = A,T,C or G
caatgtatgtatgaaatagtaacctgtgaactatncttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatagaa

SEQ ID NO: 50950 - DNA, 389 bp, Homo sapiens
caagaaaaattgttgaattagaatcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgcctgtaatcccaactactcaggaggctgaggcaggagaattgcttgaacctgggagttggaggtcacggtgagctgatatcacaccattgcactccagcctgggcaacagagcaagactctgtctcaatcaatctatccatcaatcgataagaaccccagattgtatagctacatgtttagcccccttttcaaagtatatgttc

SEQ ID NO: 50951 - DNA, 424 bp, Homo sapiens
  misc_feature 63: n = A,T,C or G
tggcgcggaggctttggcagctcgggactgtttgcaagaatcagcatgattcttcagaggctnttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattaagttgtacaat

SEQ ID NO: 50952 - DNA, 358 bp, Homo sapiens
  misc_feature 72: n = A,T,C or G
atgaagtgattctaagatttggtttggggtcaataggaaagcatatgcagccaaccaagatgcaaatgtttngaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaattggtataattatggggggtga

SEQ ID NO: 50953 - DNA, 148 bp, Homo sapiens
  misc_feature 17: n = A,T,C or G
agtggagcagtgcctgngatcccagctatttggaggctgaggcaaggagaatcatttgaacccgggaggcagaggttgcagtgtgcccagatcgcaccactgcactccagcctgggtgacagagcaagactctctccaaaaaaaaaaa

SEQ ID NO: 50954 - DNA, 124 bp, Homo sapiens
  misc_feature 17, 62, 81: n = A,T,C or G
ttgaatattaacctcangagactaaaaatttaaacaaaccaactataacgaagactggagtnctgggatttgatatatttnggggaacaattaggagggtttgagaggaaaaagcttaaaaaaa

SEQ ID NO: 50955 - DNA, 417 bp, Homo sapiens
  misc_feature 26, 394: n = A,T,C or G
cataaaaccttaaagttctgttggtntcacagaagacaaggcagagtttaaagtgaggaattttatatttaaagaactttttggttggataaaaacataatttgagcatccagttttagtatttcactacatctcagttggtgggtgttaagctagagtgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactggtattttaccaaccccctcttttttctttagctcctctggnggggaattaaacgtacttggagt

SEQ ID NO: 50956 - DNA, 130 bp, Homo sapiens
  misc_feature 32, 33: n = A,T,C or G
aaaagggtgaagaataaaagggatatgatgannaggttgatccacttcaagaattgcttgctttcaggaagagagatgtgtttcaacaagccaactaaaatatattgctgcaaatggaaaaaaaaaaaaa

SEQ ID NO: 50957 - DNA, 355 bp, Homo sapiens
  misc_feature 14, 244: n = A,T,C or G
atatttgtacagtnttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgnattataggatttttcttggtctgaatatcctgacattacagctgcaaaaacaaaactggattcagatctgtttctgaaatcttttaagctaaaatcacatgcaagaatggc

SEQ ID NO: 50958 - DNA, 161 bp, Homo sapiens
  misc_feature 41: n = A,T,C or G
aatagaagccatgtttcgaagacctgtattacaggtacttngtcagtttgtaagacatgagtccgaaacaactaccagttcggtcttgaaagatccctgaatcgtgtgcacttacttgggcgagtgggcaggaccctgtcttgagacaggtggaaggaaaa

SEQ ID NO: 50959 - DNA, 222 bp, Homo sapiens
  misc_feature 22: n = A,T,C or G
cgtaatcttgtcaaccagtgcnagttgacctgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 50960 - DNA, 386 bp, Homo sapiens
  misc_feature 49: n = A,T,C or G
atgaacacaccactctgaggctaattacctaatggaatacaagagcaanggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacacaaccctgggagagaaaacatgctaaaggaggtatcttggcttaataattccttatagccaatatcaacaggggct

SEQ ID NO: 50961 - DNA, 313 bp, Homo sapiens
agaacaggttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgc

SEQ ID NO: 50962 - DNA, 377 bp, Homo sapiens
  misc_feature 335: n = A,T,C or G
gggcacttaaaatgataatgattaacttatattgcatgttctcttcctttcacttttttcagtgtctacatttcagaccgagtttgtcagcttttttgaaaacacatcagtagaaaccaagattttaaaatgaagtgtcaagacgaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgtttcaaaagccaaagnaaaagtgaaagggaaagagaaacaagtgactgagaatcttgt

SEQ ID NO: 50963 - DNA, 133 bp, Homo sapiens
attcttaatgaccaggcaaatgccttatgtaaacaaacaagaaatgtcttaattatacaccccacgtaaatacgggtttcttacattagaggatgtatttatataattatttgttaaattgtaaaaaaaaaaa

SEQ ID NO: 50964 - DNA, 355 bp, Homo sapiens
  misc_feature 37: n = A,T,C or G
ttttaagggcttaacctgtgactttaataagctggtncagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttgggtttgacactgtatttttcacattgatttactgggtgatgataggattttataacctacggtctcatgcgggcgtaattg

SEQ ID NO: 50965 - DNA, 357 bp, Homo sapiens
ttttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatg

SEQ ID NO: 50966 - DNA, 395 bp, Homo sapiens
  misc_feature 38, 56: n = A,T,C or G
tgtctttcaatgagtaaaggaacttaagtattggtttnatattaaccttgtatctnattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtcgaggataaatccaagaaactttcaactctttgcctttcctggctttactgggatcccaaaagcatttaaggtacatgttccaaaaactttggaaaagctaaatgtttcccatgatcgct

SEQ ID NO: 50967 - DNA, 131 bp, Homo sapiens
  misc_feature 29: n = A,T,C or G
ccgcatttgcaacggtggctccataaggntgtaatggagctgaaaaattcctgccgcctagcgacgtcttgatcttgaccctgtgtaggcctagggtaatgcgtttgtatcttagtttttaacaaaagtga

SEQ ID NO: 50968 - DNA, 361 bp, Homo sapiens
tatgagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctct

SEQ ID NO: 50969 - DNA, 209 bp, Homo sapiens
  misc_feature 67: n = A,T,C or G
aggtgaagataattatataatggtaagactataaatgcatttttccttaacatgaatgaattaaacngtttattaaaaaggcagagattgtcagaaaacctgtgtaaaaacaagcaaacaaacaaaaacaaaaaataagacccaactatatgctgtccacaggagatacaccttttattcaaagatacaaatagactaaaaaaaaaaaa

SEQ ID NO: 50970 - DNA, 375 bp, Homo sapiens
  misc_feature 31: n = A,T,C or G
ggttatgtttttctgtgtgtcagttttcatnttatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctgg

SEQ ID NO: 50971 - DNA, 402 bp, Homo sapiens
  misc_feature 52: n = A,T,C or G
agaagctcatctgcagcaacttcaagccctaatagcacgaaaagaaaatgcngctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtgccctgcagtgtacgttctcacctcttatgcttagttggaactaagcagtttgtaaacttt

SEQ ID NO: 50972 - DNA, 286 bp, Homo sapiens
  misc_feature 45, 46, 62: n = A,T,C or G
gtcatgttgctgaagaatattagccaagaggtcaagagataaaannttttgtgaaagttgtntaactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaa

SEQ ID NO: 50973 - DNA, 376 bp, Homo sapiens
  misc_feature 344: n = A,T,C or G
agacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagtttttttgtacagacttagaaattatctaaagatttcatctttttacctcatatttcttaaggaatttaatgggtatatggtgncttttttcctatgtcttttggctcaagcaact

SEQ ID NO: 50974 - DNA, 390 bp, Homo sapiens
ttgtctctctgccaagatccatctaaactggagtgatgttagcagaccctgcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatgaccaaaattttaagtaggaaagtcacccaaacacttctgctttcacttaagtgtctggcccgcaatactgtaggaacaagct

SEQ ID NO: 50975 - DNA, 308 bp, Homo sapiens
cactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgctttttttttttccagcaggtttccaaccaactgggttctgcttcaataaatcttgggaaa

SEQ ID NO: 50976 - DNA, 334 bp, Homo sapiens
gagttagcaaagtttataggtgcgggtgacaaaaaagaggctttgagttttgatgactgaaaggagacaaataatagctaatctttgataaagactaactatgggcaaggctttactctttgtttgtagtaacttacttaatcctcattataacccctttatatagatgctgtattttctccattttacagagaggaagtagagcctcagagatgttatgtcacttgcaaaagtcacccagctagtgaatggctggatcaaactggatcatgtccaagtagcctggcttcaaagtcacacgctttactatatttattcttttttttttttcttt

SEQ ID NO: 50977 - DNA, 421 bp, Homo sapiens
  misc_feature 70, 71, 89, 331: n = A,T,C or G
atgaggaaataattacatcaaaaaggtcagtgacaattgataaatgacaaggaaatatttaattaggtannactaaatcattgctctcnatactaggatagactttatctacttcatctgttcctaagtcagcatgttagttctggggaaggatcataagaaaggaaatactttttaaaaaaaaaatttggaaacatgtaacaaagcaagggtaaaatatatatatatatctatataagtgctggactgtaaaagtgtctttccattaattattagccgagttaagagaatggtcacattgaagactgtggggactaagaaatgtccctgncatcatgcaatgaaatattgtatcggttaacatagctcatttatgtagaaggaattctggggggttaccccaaggtcacagttaggacgg

SEQ ID NO: 50978 - DNA, 200 bp, Homo sapiens
  misc_feature 16: n = A,T,C or G
gccaggatgggactgntcgtgtttgtggcttttctccaagtcagcacccaaaggtcaatgcacagagaccccgggtgggtgagcgctggcttctcaaacggccgaagttgcctcttttaggaatctctttggaattgggagcaccgatgactctgagtttgagctattaaagtacttcttacacattgaaaaaaaaaaaa

SEQ ID NO: 50979 - DNA, 365 bp, Homo sapiens
  misc_feature 236, 263, 302: n = A,T,C or G
ggcggtcttcagcgtgatctaaaaatgaaagcaaagtatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgcgatctagattctacatgttaccattggtttattcttgngctttctgtatttaaaactttggctgnactaagcaaatgcaaggttataatttagctaatagtagnttacagacaattctgatgattatgattcatttggttaactaagctgactagtcattcataagg

SEQ ID NO: 50980 - DNA, 354 bp, Homo sapiens
  misc_feature 38, 159, 194, 271, 332: n = A,T,C or G
gtgtgtatgtacgcacgcatgtgtcccaaatcttgttntaattttttttttctgaatgtgatcatgttttggatgatacctgagcagggttgccttttttttatttattaccattatatattatattatattatatattttttgctttcttataacttngggaggaaagtcaaatcttggattattaaaattgnttaaaaaggagtaaattttccagttgataaatgaaaatcactggcctatgttaaataagtttttctttaattactgngggaataacggccagctatcatcaacacaatgattttggacatagggtagggaagcagggngctctcaatgggaagatgtgca

SEQ ID NO: 50981 - DNA, 294 bp, Homo sapiens
tttgcccagcgacagagctgcatgaatacgtttgccagctggtttgggtacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgtctctcttcccagtgcagatccactcatcagcagagccagattgtgccaactatccaaaaacttagatgagcagaatgacaaaaaaaaaaaa

SEQ ID NO: 50982 - DNA, 352 bp, Homo sapiens
gaaggaatttggcagagcttgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgcaaatcttcaatggaacctttgtgaagctcaacaaggcttcgattaacatgctgagggattgtagagccat

SEQ ID NO: 50983 - DNA, 362 bp, Homo sapiens
  misc_feature 30: n = A,T,C or G
gatagcgggtgcctgtaatcccagctgctngggaggctaaagcaagaggattgtttgaacctgggagtgggaggttgcagtgagccgaggtcgtgccattgcactccagcctggccaacaagagcgagactctgtctaaaaaaaaaagaaatgcttgctttctgtgtagttttttaacttaggtcaagcgccataggactgaccaaatcataaattgaggatgctgttggtattcaaagtttttactcattacccttactcagtttgcagctgcaatgatctgtacttaacctgcttttacatattatgcttccttgacaatggggaggaattttaatggttaacttgcagaatatgacaga

SEQ ID NO: 50984 - DNA, 405 bp, Homo sapiens
  misc_feature 49, 374: n = A,T,C or G
agatagttacatatttttctcatctaggctgtgtcactattgggtgcanggatatcattgttggctaggattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtcatagtaggtgctcaacaaatttattgaatgaatgagtgaatggaaaaactgggagagtcaaaagtgagcagaagctctccatttctacttctgtcacaaaccacattaaattgtaaataaggcccttctncacttgacttcaggcagcagattggctaaaa

SEQ ID NO: 50985 - DNA, 309 bp, Homo sapiens
  misc_feature 32, 33, 65: n = A,T,C or G
ttaatttttaaaaataatttttttgggctggnnatagtaactcatacctgtaatcccagaacttnggaaggccaaggcaggtgggatcacctgaggtcaggagttcgagaccagcctgatcaatatggtgaaacccccatctctgctaaaaatacaaaattagctgggcatggtggcacacacctgtagttccagctgctcgggaggctgaggcaggagaatacctttaacccaggaggcggaggttgcaatgagctgagatcgcaccactgcactccagccagggctacaagagcaaagctctgtctc

SEQ ID NO: 50986 - DNA, 115 bp, Homo sapiens
cttccaagcctttcctgacttcctcttagatcatagattggacctggttttgttttcctgcagctgatgacttgttgccctgaagtacaataaaaaaaattcattttgctccaaa

SEQ ID NO: 50987 - DNA, 354 bp, Homo sapiens
ttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgtcctacttctgagaccaagactcttttgcatattctttagcaataggacgggtaaagactggatttaattgctgtcagaagtata

SEQ ID NO: 50988 - DNA, 112 bp, Homo sapiens
  misc_feature 32: n = A,T,C or G
catgtatgtatttatagaaaatatttgctgtnttaatcttttctttttaaacaaggactcatacttaaaaaaatgtttagcaaaaaaaaaaaagggggagaactttaaattt

SEQ ID NO: 50989 - DNA, 276 bp, Homo sapiens
  misc_feature 207: n = A,T,C or G
atgacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtnaggggcgcactctgtatggcttcggcgggtgaatctaaagaatacgcggtctcctggagaacttcaaaa

SEQ ID NO: 50990 - DNA, 355 bp, Homo sapiens
  misc_feature 126, 133, 289: n = A,T,C or G
ttttttaccagacgctaaagcatatggagatagaatagaaagaatgcttcgcctcagtttgaacattgaccctgatgcaaaggtggaaagaagagcccgaagaagaacctgaagagacagcagaangacacancagaagacacagagcaagacgaagatgaagaaatggatgtgggaacagatggaggaagaggaaccagcaagggaatctacagctgaaaaagatgaattgtaaattatactctcaccatttggatcctgtgtggggagggaatgtgaaatttacatnatttcttttggggagagacttgttttggatgccccctaatccccttctcccctgcctgtaaaatgg

SEQ ID NO: 50991 - DNA, 264 bp, Homo sapiens
tacttgcgtacatgcacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaat

SEQ ID NO: 50992 - DNA, 389 bp, Homo sapiens
  misc_feature 34: n = A,T,C or G
ctctgtaaaaacgtgtagtgtttcataaaatctntaactcgcattttaatgatccgctattataagcttttaatagcatgaaagttgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagtctttatgtatttcttattggcattcaacatatgtaaaatcagaaaacagggaaattttcattaaaaatattggtttgg

SEQ ID NO: 50993 - DNA, 424 bp, Homo sapiens
  misc_feature 33, 412: n = A,T,C or G
gccgcttgccttgctctcagaatcgctgccgcnttggctagtcagtctcaggggattcagcagctgctgcaggccgagaagcggggcagccgagaaggtgtccgaggcccgcaaaagaaagaaccggaggctgaagcaggccaaagaagaagctcaggctgaaattgaacagtaccgctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagaaagaagcacctgtgctgnggagtggcattt

SEQ ID NO: 50994 - DNA, 317 bp, Homo sapiens
  misc_feature 27, 68, 201: n = A,T,C or G
gttctttaccttttgtggttgaaaggnaggagtgcaatgagtgtgtgtggtctgagtttttgtggacngtgatctacatttaatctggggaaattaattccctaagctgctggcaggcagcatgtacttgttaattattcaggtggatgacaaatgcagagcagaggttctcgcaaagacaaagtttgtatgatgcatgtntagtaactgataggcctgacattctgtggtgcttattcagtgctaatcctaataagctgcctggtgcgatgaacgcctttttctctgtcctctgcagaagaaaacagagatcttga

SEQ ID NO: 50995 - DNA, 366 bp, Homo sapiens
atgtgaaggaagacttgaacttgaccgtgaggaagagaaggtatttgcagaggctcccagaaagaaagttagatgtgtacaccattgtgtgacctgagaaggccaaaacactctctaaagaacagtgtttgttcaaagaaaattctctgattctcattcctgttccatatgcaccctccaatttccacaggttaaaatctcaagactgtcagcgatggggttctattagaataagtgtgactgagtatctttgaagaaacaatctcagatcccaaatccatagcaagtctaggcacatagtatatatactacttgcatatatgaaattgatgctgaaagtgtgcaaaagtatctctagatagaagg

SEQ ID NO: 50996 - DNA, 426 bp, Homo sapiens
cactctgtaaggagtggaaaagcatcctgttatttataaactcacaatgaaaaatctccagatcacatgaagaaatagactagaataaagtcagcagattcaacaaatgaagaactagaaataagatataaatataaaggtttctatcaaatacatatgcttacaataagaaaagaaatagagaataaataggagccacagtgaaaaagaaaccactatgaaaaacaacagtaaaaaaagacagactagaaatgaaaaatatagtctttgaaattaaacactaattaaatagcacagtggacacagccaaagatagaattaataaactggaagatcaaagaaaatcagccagaatgaagccctgagaactgagatgaaaaatatgatatattaggtgacacaaaagatagtaaaaggggatagtgt

SEQ ID NO: 50997 - DNA, 350 bp, Homo sapiens
tgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatacaaagaggttggatcaagtttaaatgactgtgctgccctttcacatcaaagaactactgacaacgaaggccgcgctgctttcccatctgtctatctatctggctggcagggaaggaaagaacttgcatgttg

SEQ ID NO: 50998 - DNA, 383 bp, Homo sapiens
  misc_feature 26, 33: n = A,T,C or G
aaaataatatgtacacaggagggggngggaacntatacacataagactgactttaaagtatgtatatatgtacacaggtgtgtatgtgaacagtacacataataatatacttacatggtgacaatattgtgttgtgattagggcagttaaaagcagagactatggcttaggaaagacctgtctgagatacccagctctgctgtatgaccttggcagcctacttaaccttcataggcatcagctgtggcatttctagagtgggaataatactacctctctcatatatggctgctgtgagagttcaagtgagatcaagtgaaagtcaaggctcttagcagtatcacatagtggggcctcattgatagttattatcggaggaagac

SEQ ID NO: 50999 - DNA, 122 bp, Homo sapiens
aaaacaatatgagtgtcagcagatttctcaggagaaaccatgaaggccagaaggaggtggtacattttccaagtgttgaaacaactgtcgactcataattctataagacattcacaaaaaaa

SEQ ID NO: 51000 - DNA, 417 bp, Homo sapiens
  misc_feature 31, 43, 49, 56, 360: n = A,T,C or G
cgtgacatcattcagcgcatgcttcttcgtnagtacgagctgntctaanaagggancccccaaatttaattaaggccttaagcacaattaattaagagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgngttgtgcagcattaaaaaaaatcaaaataaaaattaaatgtgagccaaaaaaaaaat

SEQ ID NO: 51001 - DNA, 221 bp, Homo sapiens
  misc_feature 49: n = A,T,C or G
ctacagcttataaaatagtgtgggttttgtgaaaattttggattagctntcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaa

SEQ ID NO: 51002 - DNA, 239 bp, Homo sapiens
agcctggactgctacctttgaaagcttggagggaagccgtgaattcagttggttcgttctgtactgttactgggccctgagtctgggcagctgtcccttgcttgcctgcagggccatggctcagggtggtctcttcttggggcccagtgcatggtgccagaggtgtcacccaaaccggcaggtgcgattttgttaacccagcgacgaactttccgaaaaataaagacacctggttgctt

SEQ ID NO: 51003 - DNA, 131 bp, Homo sapiens
gatagaggtgtttttctgtttttccttgctcatttcgttttggggaagaaatctgtactgtattgggattgtaaagaacatctctgcactcagacagtttacagaaataaatgttttttttgtttttcaca

SEQ ID NO: 51004 - DNA, 347 bp, Homo sapiens
  misc_feature 342: n = A,T,C or G
tgaggtcctgagctacttagggctgctcttttatataagcagtgtaacgtgacatgcctttttaaggtcagcagaacttctgactagaatctgtttcagagaaggccagaaagagttcacttggttaggtcagagtcacctgggatagtctcccttttgattaagtcagagtcaactaaataggcaccttaattgcatctgcaaaatcctttcacttttgccatattctcttactaaatgtaacaggcgttgccacacaaaggtatggatatggggcttggaaaggatttcaggaaccatcttagaattctgcctactactaactccattctacaagtcttnaatat

SEQ ID NO: 51005 - DNA, 209 bp, Homo sapiens
  misc_feature 26, 57, 73: n = A,T,C or G
acttgaacctggtaggcagaggtttnagtaagctgagatcgtgccactgcactattngttagctatttgactngtgggaaagttattctctgagccttgatttctcattagaagacgggaataatagcaaacctatctcagagcattaagtaagaattaaatgaagtgaattaagcacgaaacctagcatctgacgcatagtaggggcc

SEQ ID NO: 51006 - DNA, 311 bp, Homo sapiens
  misc_feature 219: n = A,T,C or G
actaacccttccctgaggtttgtgtatgttggatattgtggtgttttagatcactgagtgtacagaagagagaaattcaaacaaaatattgctgtcttcagttttgtttgtggaatttgaaattactcaaatttaaaataaattactggactgtggaaataacatagaattgaagttttaattaaataccactcaaacgaaaagaacagtagttttcgnaggtttatattggatactgagcattagggaggcatgaaaggaaagaggaatgaggattgagacatgtgaagacattgtgcattatatcaatg

SEQ ID NO: 51007 - DNA, 345 bp, Homo sapiens
  misc_feature 235, 307, 325: n = A,T,C or G
gaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgangatgccaaggacttcttcaagaggaagatagattttctaaccaagcagatggagaaaatcaaccagctcttnaggagaagcacccattgnaacaggccgtatggaaatga

SEQ ID NO: 51008 - DNA, 326 bp, Homo sapiens
  misc_feature 225, 319: n = A,T,C or G
gttttctatcccagttctttggcttttactaaaaatggacgcctgcaaccaagtatcataccgttccactgccaccaaaaggaagggttttaatccattggatgacgctttgtcaaacacaaatgaaattaatggcgattcctctagtctttcagattatgtttgggaatattaaatggtctataccattatgcagtatttgaagagacacttgagaaaactatncatgaagagtaccaaaaaaatgaatggttgctaacttagcaaaatgaagtttctataaagaggactcaggcattgctgaaaggagttaaaaagnaacttgg

SEQ ID NO: 51009 - DNA, 225 bp, Homo sapiens
aatgatacatcagtgtaggttcattgattgtagcaaatgcaccactctggtatgggatgttgatagtggggaggccatatgtgtaggggtagggggtgtgtgggaactgtctgtactttcatctcaatttagctgtgaatctaaaactgctctaaaaaaaataaaatccattttttaaaacctaaatataaactatgtgcaaagacatactttcaatataaagac

SEQ ID NO: 51010 - DNA, 313 bp, Homo sapiens
ctaagatttggtttgggatcaataggaaagcatatgcagccaaccaagatgcaaatgtttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctggtatttatcaattttcccagtatttttatacggaaaaaattgtattgaaaacacttagtatgcagttg

SEQ ID NO: 51011 - DNA, 108 bp, Homo sapiens
attatagagtcataagcatcctttatatattctgaatataactcttttatcagacatacatatatatcaaatatttttttctaagtttgtggattgtgtttttacttt

SEQ ID NO: 51012 - DNA, 201 bp, Homo sapiens
tggaaggccagcttcaccaccttcactgtgacgaaatactggttttaccgcttgctgtctgccctctttggcatcccgatggcactcatctggggcatttacttcgcattctctctttcctgcacatctggcagttgtaccatgcattaagagcttcctgattgagattcagtgcatcagccgtgtctattccatctacgt

SEQ ID NO: 51013 - DNA, 413 bp, Homo sapiens
  misc_feature 63, 79, 379, 383: n = A,T,C or G
tattcggtgagcggtggtggtttattcttctttggagttaagggctccgtggacatctcaggncttcagggtcttccanctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaattataaactcaatgaggcatggcttgcagtgtggcaggcataacttctgatgctaatgttctgactaatgaactaaggctnatgntcaaagggatttattacagtataaggagct

SEQ ID NO: 51014 - DNA, 179 bp, Homo sapiens
  misc_feature 55, 59, 71, 123, 151: n = A,T,C or G
gtgagcggtggtggtttattcttctttggagttaagggctccgtggacatctcangggnttcagggtcttncatgctggaactatataaaggtcaagaaaacatgtcttcgaagatatgactncaggaccactatattttcttcagaaggncggttataccaagttgaatatgccatgg

SEQ ID NO: 51015 - DNA, 107 bp, Homo sapiens
caattttaagttatgaagtttttaaaatcagtactttttaatggaaacaacttgaccaaaaatttgtcccagaattttgagacccattaaaaaagttaaatgggaaa

SEQ ID NO: 51016 - DNA, 243 bp, Homo sapiens
  misc_feature 8: n = A,T,C or G
cccctagnagcggcgagctgaacggggagcagcccagagtcttaatcaatagcagtgtcaggagaacggtctggaaagtccggcagtaaagggtgatagccccgtatctgaagatgctgttattgtgaactcgacgagtagggcgggacacgtgttatcctgtctgaatatggggggaccatcctccaaggctaaatactcctgattgaccgatagtgaaccagtaccgtgagggaaaggcga

SEQ ID NO: 51017 - DNA, 196 bp, Homo sapiens
tgccgacaaaatttccagttatttatttccaaaatgttcggaaacagtataatttgacaaagaaaaatgatacctctctttttttgctgttccaccaaatacaattcaaatgctttttgttttatttttttaccaattccaatttcaaaatggctcaatggtgctataataaataaacttcaacactctttatggt

SEQ ID NO: 51018 - DNA, 305 bp, Homo sapiens
  misc_feature 9, 83, 88, 185: n = A,T,C or G
ctctttganagatagagattaatacaactacttaaaaaatatagtcaataggttactaagatattgcttagcgttaagttttnaacgnaattttaatagcttaagattttaagagaaaatatgaagacttagaagagtagcatgaggaaggaaaagataaaaggtttctaaaacatgacggaggntgagatgaagcttcttcatggagtaaaaaatgtatttaaaagaaaattgagagaaagggactacagagcccccgaattaatccaatagaagggcaatgcttttagattaaaatgaaggtg

SEQ ID NO: 51019 - DNA, 304 bp, Homo sapiens
ggccagcggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggcctgatcaagaatttggtgtggccgttggccctgtttgctttttataaaccaaactctatctgaaatcccaacaaaaaaaattaactccatatg

SEQ ID NO: 51020 - DNA, 150 bp, Homo sapiens
  misc_feature 3, 26: n = A,T,C or G
agnatgtagaaagttgtaaaatattnaaaagtggagttggtgaatcggttcgttctttcctcacatttggatgattgtcataaggtttttagcatgttcctccttttcttcaccctcccctttgttcttctattaatcaagagaaacttc

SEQ ID NO: 51021 - DNA, 330 bp, Homo sapiens
  misc_feature 29: n = A,T,C or G
gattcttcccctctctacaaccctctctnctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaa

SEQ ID NO: 51022 - DNA, 310 bp, Homo sapiens
  misc_feature 15, 279: n = A,T,C or G
cactatacataatcnacatacgaaaaagtaattaagacttattgctgttcagtctactttaggaaataacagcttggaatataaaaatttttgtaaataaactgctctcaagtagtcagtccatagttagccatgaggaatttcttctggtttatggtagctctaccagttttattttattgctactatgttatatttgacatggctcatctgtcattttataaatttcaactttaaataatctactattaactttcagacaataactgtgcacattcnaaatcaaaagactccatgttatttactctta

SEQ ID NO: 51023 - DNA, 155 bp, Homo sapiens
  misc_feature 24: n = A,T,C or G
gatcatattcctattaataacatnattgttggtggctgaatacattttggaagagagtttttcatcttagagattggtgaacaagtgtgagggtgtgagaaactcacagaatacaaatttgcctgtatgttttgtgggttttttttttttccttt

SEQ ID NO: 51024 - DNA, 183 bp, Homo sapiens
  misc_feature 166: n = A,T,C or G
aatttcaaaaaatgatttgttaaaagtactgtctgctagacccttgcctttgagtggctttgaaacttaatatagtttttaaaaagtgcaatgggatgagattatgctattagtatattaaaagcctgtttctgttttactccaatttgtaagatcatttaatggnataaagatcacaacagc

SEQ ID NO: 51025 - DNA, 370 bp, Homo sapiens
  misc_feature 4, 29: n = A,T,C or G
tgcncgtggatcagaaattgctcctgtgnggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttat

SEQ ID NO: 51026 - DNA, 213 bp, Homo sapiens
caagcaccagcttgggcaacatagcaagaccctgtctctacaaaaaagaaaacaattagccaggcatggtgatgtgcacctgtagtctcaactactctggaggctgaggtaggaggatcacttaagcatgggaggttgaggctgcagtgagctatgacctgccccactgcactccagcctgggtggcagagtaggaccctgtatctaaaaaaa

SEQ ID NO: 51027 - DNA, 400 bp, Homo sapiens
  misc_feature 28, 382: n = A,T,C or G
gagccgatttgggatagactaggtttcnttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggnataaagctgtgaacttcg

SEQ ID NO: 51028 - DNA, 205 bp, Homo sapiens
  misc_feature 23, 170: n = A,T,C or G
aggggttggaaaaaccacactangcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaantgagagaaggtggagttattgttgattaccatggt

SEQ ID NO: 51029 - DNA, 360 bp, Homo sapiens
  misc_feature 96, 150, 155, 177, 350: n = A,T,C or G
cagacaatgattgaagctcacgccgatgtcaagactaccgatggttacttgcttcgtctgttctgtgttggttttactaaaaaacgcaacaatcangatacggaagacctcttatgctcagcaccaacaggtccgccaaatccggaagangatgntggaaatcatgacccgagaggngcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagccttcatggngaaggcagta

SEQ ID NO: 51030 - DNA, 300 bp, Homo sapiens
  misc_feature 14: n = A,T,C or G
atatcggatttgcncaaaacaagcctaaagaagctactttatagtatagccaggtttccctgcatcctgatatctgggaagaattgtaggcagaattaggaaaagaaactgcatttagaaaattcaaaaacttactaggaaactattctgtattgtatatatttcaaataaaagtttaatatcggtttgctgctcaaggaaatagttgaaatgtcaaaatttacctatcgtaattcgaaattgcatgtatgttttgttagaaagttcgtagtaatgctgaatcctacataaacattgtgt

SEQ ID NO: 51031 - DNA, 180 bp, Homo sapiens
  misc_feature 15, 121: n = A,T,C or G
ataatcaagatggtnaagctgagcttccgttgtaatgaggagaatcttttttattggtttttcaatctcttcccctcgagtggtctatgtgatctaagacatttccaacttttccgctgtntaaaaaaaataaaatcctagactctcttaatgttatacctccttcttgatactaccctg

SEQ ID NO: 51032 - DNA, 300 bp, Homo sapiens
ctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgggagtaaaaaatgtctttaaaagaaaattgagagaaaggactacagagcc

SEQ ID NO: 51033 - DNA, 360 bp, Homo sapiens
gtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtccgtggatgctgttgtcacctcaggtcaacaaggtt

SEQ ID NO: 51034 - DNA, 379 bp, Homo sapiens
  misc_feature 367: n = A,T,C or G
taaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacnataaaagctcct

SEQ ID NO: 51035 - DNA, 410 bp, Homo sapiens
  misc_feature 25: n = A,T,C or G
gtaacatgttgcatgtggcttattntggatatatctaaggcccttctgcacatctaaacttagatggagttggtcaaatgagggaacatctgggttatgcctttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaattta

SEQ ID NO: 51036 - DNA, 383 bp, Homo sapiens
tcctcctctgtcttttggagaaccgggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcatgaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatggcc

SEQ ID NO: 51037 - DNA, 310 bp, Homo sapiens
  misc_feature 55, 56, 138, 162, 175, 202, 240, 280, 304: n = A,T,C or G
ttacctgtctattgctttggacagaacctttagtttaagagtaggtagacttacnngttcccgagtttaatgaaaatgcttctaatttcatcatttaagtttgacgttttttatactctttattgagacaattattgnaccatcttttctgtatttgagtgnttatcatgaatgntaaattttatcaaatgcttattttgtnttaatttgggattatttcatcttttattgggataatgnattatattattacaggttcttatatttaatgggcattacnttcctgagataaaggctacttggnccctaa

SEQ ID NO: 51038 - DNA, 410 bp, Homo sapiens
cttgaagaacaggtttccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaac

SEQ ID NO: 51039 - DNA, 232 bp, Homo sapiens
  misc_feature 22, 46: n = A,T,C or G
aagggacaagcatcaagcacgnttaatgcagctcaaaacgcttagnctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccccccccccaaaaaaaaaaa

SEQ ID NO: 51040 - DNA, 500 bp, Homo sapiens
  misc_feature 6, 21: n = A,T,C or G
ataaanaatatccaattaatnccaaatgaaggtagaaatacaaaaaggggaaagaacagcaagagataaacagaagtacagtaaatttaaatgtaaccatatgacaaagcaaaataagtgtaaatggcctaaatattaaaaggcagagattgtgagactgaatcaacaagcaagactcaactatatactgcctatgtaaaatatacttcaaatacaaaaatatcaataggctgaaaataaaatgatgtaaaaataaataccatgctatcactaatcaagtgtacatttatacatttcaagtgtataagtatgcatttcagcaagagacagctgaaatggctacattaatataagacaaactagatttcaaagctcagaagatttacagggaaaaaggaggttattaatacaagataaacagtcaattcaacaaaacattttaaaatgataatgcatttaataacactgtttcaaaacatatgaagcaaaaactgatggaa

SEQ ID NO: 51041 - DNA, 450 bp, Homo sapiens
  misc_feature 23: n = A,T,C or G
gtaatcactggtgtcgatattgncatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaccatgaatccagatggcatggttgctctattggactaccgtgaggatggtgtgaccccatatatgattttctttaaggatggtttaagaaatggaaaaatgttaacaaatgtggcaatttattttggatctatcacctgtcatcataactggcttctgcttgtcatccacacaacaccaggacttaagacaaatgggactgatgtcatcttgagctcttcatttattttt

SEQ ID NO: 51042 - DNA, 350 bp, Homo sapiens
  misc_feature 24: n = A,T,C or G
aaactaccaaacctgcattaaaantttcggtgtggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttaccgacctcgatgttggatcaggacatcccaatggtgcagccgctattaaaggttcgtttgttcaacgattaaagtcctacgtgatctgagttcagaccggagtaatccaggtcggtttctatctactccaaaaaaaaaaaaaaaaaaaa

SEQ ID NO: 51043 - DNA, 427 bp, Homo sapiens
  misc_feature 24, 25: n = A,T,C or G
gacgtgataagcatacataatgannaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacag

SEQ ID NO: 51044 - DNA, 500 bp, Homo sapiens
  misc_feature 18, 24, 33: n = A,T,C or G
ttagcaatgacagttacnaaaagnacagtaacnttatgctgacgagaatgcagaggcaaaggaacgtttaaacactgttagtgggaatgtagacttgtacaaccgttatggagaagagtatggaggttcctgaacaaactaaatagaactaccatatgattcagcagtcccactactgggtatatatccaaaagaaaatccatatatggagacatctgcacctgccatgctcgttccagcactattcacagtacccaagattggaatcaacctgtgtctatcagcaaatgaacagataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtgggaaggtaaaaaagatctcatagaagtagagagtggctcatgcctctaatctc

SEQ ID NO: 51045 - DNA, 280 bp, Homo sapiens
  misc_feature 25, 219: n = A,T,C or G
cagtgtgactgttgtttttgttccnggggtgggtttggggttttttgcttttttattcctgaagcttaccagatatgaatggctaatactccattgttctgcttgttgtaatggtgaatgctttaagaaaaaaaagtgtaatttgctaagattaattcatgatctgtttatgcgataactcctttttgttacaatttttttaaaaaaagctatttttgntaatgtaaagtaaatatttcagagcaaattttttaaacttattgcactaaatacaggctct

SEQ ID NO: 51046 - DNA, 211 bp, Homo sapiens
  misc_feature 6, 32: n = A,T,C or G
gggggnatggaaaataagtagaaacaaaaaancagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatgaaaaaaaaaaaaaaaaaaaa

SEQ ID NO: 51047 - DNA, 190 bp, Homo sapiens
  misc_feature 28: n = A,T,C or G
tagcatgaactgaagcagaagttatcantaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaaaaaaaaaaaaa

SEQ ID NO: 51048 - DNA, 337 bp, Homo sapiens
  misc_feature 23, 24: n = A,T,C or G
gcataatatagcaggactagccnntataccttctgcataatgaattaactagaaataactttgcaaggagagccaaagctaagacccccgaaaccagacgagctacctaagaacagctaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaaaaaaaaaaaaa

SEQ ID NO: 51049 - DNA, 500 bp, Homo sapiens
  misc_feature 14, 52, 496: n = A,T,C or G
ttttaccaccaagnaacttcatgagtgttttatgaaggaatagttgacaccntctttagctgtgatgccaatatttggaaatctttgaaaaaacaaagagggaaaaaagatggagacgaggtttttaatctttccagaaaactttaaaaatgtctttagaaataaacaagaacataatagccctgtaatctggttctgctcttcatatattaatagtatcctaactcacacctcctgtaccttaagaccttgactactcacaatgaaataaactgctggatgccaagaagttttactcttccttccagttatttaataccacaatgccatgaacaaaatagcaatgagtaaacatttgtaagtaaatttatatttcaaagtcacgaaacattttagagcatgttgatctcatacactatcaaagataggcaaaatggtttaccatctgataattccaagtcaaaatagtatataccaatttttcaatcaaatcagntttt

SEQ ID NO: 51050 - DNA, 169 bp, Homo sapiens
ggcgcactagatatagtaccgcaagggaaagtatgaaaaattataaccaagcataatatagcaaggactagcccctataccttctgcataatgaattaactagaaataactttgcaaggagagccaaagctaagacccccgaaaccagacgagctccctaagaacagct

SEQ ID NO: 51051 - DNA, 470 bp, Homo sapiens
  misc_feature 31: n = A,T,C or G
cttccccctttgtgtcctccttctttcactnacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacattagtagataacatatcaacaatggctctgctatgcacggaaaggggagcacccggagtcagtgtcgatatgaacataacgtacatgtcacctgcaaaattaggagaagatatagtgattacggcacatgttctgaagcaaggaaaaacacttgcatttacctctgtggatctgaccaacaag

SEQ ID NO: 51052 - DNA, 500 bp, Homo sapiens
  misc_feature 6: n = A,T,C or G
gaggcntgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataattttgaaggcgatcttttaaaaagagattaaacccgaaggtgattaaaagaccttgaaaatccatgac

SEQ ID NO: 51053 - DNA, 230 bp, Homo sapiens
  misc_feature 6: n = A,T,C or G
aggcantgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcaaaaaaaaaaa

SEQ ID NO: 51054 - DNA, 417 bp, Homo sapiens
  misc_feature 8: n = A,T,C or G
agaaacantgagggctaaatattcttgcattctgaagagaagtactagacaccttactaaaggcagaacaggttcaacagcaatcaaactacatccctcaattccagtctacaaatgaaagggattgaagaaagtcactgaagcataacactgctgcatttgtgggcagggctgagatttcccctgagggaactccccaactcaaaccaaatgaagggagctcccagagagaaccagtcatctgcaagaagaggaggctctgtccctataactgtccccccactgatgctgactatgttgctggatgttacaggcacctcggtgcattaaactacagcaagacagttcatgggagaacccaacatatgtctttaggaattgaggacgtacataaatgaagagacttgtgtgaaaaaa

SEQ ID NO: 51055 - DNA, 194 bp, Homo sapiens
  misc_feature 31: n = A,T,C or G
aactgcacttggttctaggaggagagaattnatgtttggtcaacagaacttttcgccgccacttaagtttactgcttcaatatcttttccttactaattgattgttaattaagtagtgtccaagtgagttagcctttttagggttgattaattaaaagagcagcaagaatggcattttaaaaaaaaaaaaaaaa

SEQ ID NO: 51056 - DNA, 230 bp, Homo sapiens
  misc_feature 6: n = A,T,C or G
atttgnatgatggccttcatccttactatttagttcaggtttcccctctaccaggaattttctgctagatgtaaacctccatcctgccttccttaagaaatcttgtcctggctaggcgcagtggctcacgtctgtaatcccagctgaggcaggcagatcatgaggtcaaggagttcgagatcaacctggccaacatagtgaaacgccatctctaccaaaaaaaaaaaaaa

SEQ ID NO: 51057 - DNA, 300 bp, Homo sapiens
  misc_feature 299: n = A,T,C or G
gctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacant

SEQ ID NO: 51058 - DNA, 360 bp, Homo sapiens
gcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcaaacggtagttttgtgtgttggctgctccactgtcctctgccagcctacaggaggaaaagcaaggcttacagaaggatgttccttcaggaggaagcagcactaagagcactctgagtcaagatgagtgggaaaccatctcaataaacacatttttgggttaaaaaaaaaaaaaaa

SEQ ID NO: 51059 - DNA, 337 bp, Homo sapiens
  misc_feature 32, 33: n = A,T,C or G
ctcagacgtgggatgcagatcttcgtgaagtnntcctgactggtaagaccatcaccctcgaggtggagcccagtggcaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccctaaaaaaaaaaaaaaaaaaaaaa

SEQ ID NO: 51060 - DNA, 450 bp, Homo sapiens
  misc_feature 16, 30: n = A,T,C or G
agagaccatcccgagngtaaatcatctttncatccagagaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaaagtcacccaaacacttctgctttcacttaagtgtctggcccgcaatactgtaggaacaagcatgatcttgtta

SEQ ID NO: 51061 - DNA, 100 bp, Homo sapiens
actaaaaatacaaaaattagctgggcggtggcgcatgcctgtactcccagctactcgggaggctgaggcacgagaattgctggaacctgggaggcagagg

SEQ ID NO: 51062 - DNA, 349 bp, Homo sapiens
  misc_feature 20, 47: n = A,T,C or G
agcaaatggaaatatatggnggtattttcttacattatatgtaaggntatctgatattatttgaaaatagattgtgatgagtttaagatgcacattgaaatgacagaagaaacacaaaacaaaagaatacaaagtgttatagctgataaatctatataaaatagaatcctaaaaaattcaattataaaataggggaggaaaagaagagaaaaggaacaaaaaagagacgggagaaatagcaaggtggtagaagtaagctcaacagcatctataaccacattaagtgtaaatgacctaagagcttcaatatagtggtagagactatcatactggcctaaaaaaaaaaaaa

SEQ ID NO: 51063 - DNA, 400 bp, Homo sapiens
  misc_feature 23, 371, 389: n = A,T,C or G
tatggccgggactaacaatcatncacgaaccgttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggnggggtgattttgccttgngataattatca

SEQ ID NO: 51064 - DNA, 188 bp, Homo sapiens
aggattaatctgagggacccacagcacacttaacacaatcaaatctcagaaaaaaaatcagttatttcattgtgattttgaggctgatcttttatgatcttttagttatcaaactgttaaatacattttaactttcaaattttatgaataaaggagatgaatcctgttaataaaaaaaaaaaaaaaaa

SEQ ID NO: 51065 - DNA, 200 bp, Homo sapiens
  misc_feature 89, 102: n = A,T,C or G
ataaacacaaattaatgttttatagaccctgggaaaaagaattttcagcaaagtacaaaaatttaaagcattcctttctttaattttgnaattctttactgnggaatagctcagaatgtcagttctgttttaagtaacagaattgataactgagcaaggaaacgtaatttggattataaaattcttgctttaataaaaat

SEQ ID NO: 51066 - DNA, 300 bp, Homo sapiens
  misc_feature 26, 224, 229, 243: n = A,T,C or G
atagaaaataaacttattaggaagcnttttcttaaagtgtttcttgctgtcttttctatctgctctaatgttttggtccttttattgagtttttattgcttttgatgtcagggcttatttaatctctagtgcatgaaagtctcatatgtaaaaaaatgattattctgaatttaatctgtcattggtcatacttctaagtgttcaaccttataaaaaaaaaaaangactntcaaaaaagaaaanccttacattatgttctagtagttaagtttccaaggacagggatcactagtctaccat

SEQ ID NO: 51067 - DNA, 126 bp, Homo sapiens
ggcgcactagatatagtaccgcaagggaaagtatgaaaaattataaccaagcataatatagcaaggactaacccctataccttctgcataatgaattaactaaaaaaaaaaaaaaaaaaaaaaaaa

SEQ ID NO: 51068 - DNA, 262 bp, Homo sapiens
  misc_feature 6, 12, 31: n = A,T,C or G
atttcnaaaaanaaaaaaatctgtgaaaagnaatagtggttcctcttgatgtatagtatgcctgtattatagtttttacaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaagaaaaaaaaaaaa

SEQ ID NO: 51069 - DNA, 290 bp, Homo sapiens
aagagggacggccgggggcatttttattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaacaaaaaaaaaaaaaaaaa

SEQ ID NO: 51070 - DNA, 490 bp, Homo sapiens
cggtttcggtagcgacggtagctttagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgttttgaac

SEQ ID NO: 51071 - DNA, 160 bp, Homo sapiens
aatctcgagtaaagttacatgtaaaaaccaagtaatgataaaattccacgatttatgataaaatttatgataaaattccacgattattataatatttggtttgattttgattaaaatatgcctacttttagtttaaaataacagaccaaaaaaaaaaaaa

SEQ ID NO: 51072 - DNA, 400 bp, Homo sapiens
caactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacgggttttctttgtttttggttcctttttaaattatgcata

SEQ ID NO: 51073 - DNA, 314 bp, Homo sapiens
  misc_feature 6, 32: n = A,T,C or G
aataanaataaattatagaataaaaatgaganaagttatagtcgttttttgtacaataatacagtgtataaaggctaacgtcagtaatgtcaactttgttgaatggaaaatcctgaactggcagttgactctatttctgtcaaatcctgcttttatgttatgtcactctctgattactcagacctttctctatcctactatgaaactgagtgattctcagaaaggaaccaggacattctatcacttaatgccaaacacgttaaaacgaaagctatgaacaggcttcccaacattttgtagggttaaaaaaaaaa

SEQ ID NO: 51074 - DNA, 440 bp, Homo sapiens
taatattctctgatttcgggagaattctgtcagtcacatgatgattatgtttttgtttaacattctttccatgcacttgttattttattaatttgcctgaatgatgagaccagaccagtgtctacagattttcattgtcaagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctc

SEQ ID NO: 51075 - DNA, 560 bp, Homo sapiens
  misc_feature 542: n = A,T,C or G
agacaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatcagcagccactacaaacacatcaccgcagatgtgccttctggggcctcagtggggacaactgagcactttgtgcctctgagcaggcatcattgaagtgagggactttggctttttgtgaccaaatcagcccacactgcctgtctgaatgtctgcattcctgctgtcttgncattctgggtcaagaccc

SEQ ID NO: 51076 - DNA, 250 bp, Homo sapiens
  misc_feature 144, 179, 187, 216, 223: n = A,T,C or G
aaaatatcctacttctgggagccctttaattcctccccctacccccatataaatcaggcatgcaggaggcctgatatttagtaatgccattgtgcttgaccttgaaggaaaatgctattagcccgtcgagcttgatttgcttgntgtccttgaataagcatgtcatgcatatgtgtcgncgagtttntatttttacaccatattgtattacacttntagtatncaccagcatgaatgcactgtctgccta

SEQ ID NO: 51077 - DNA, 340 bp, Homo sapiens
ggcgacctgcgactccttgacgttgacaatcgagtagtactcccgattgaagcccccattcgtataataattacatcacaagacgtcttgcactcatgagctgtccccgcattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcccaaaaaaaaaaaaaaaaaaaa

SEQ ID NO: 51078 - DNA, 500 bp, Homo sapiens
tatggccgggcagacgagctacctaagaacagctaaaagtagcacacccgtctatgtagcaaaatagtgggaagatttataggtaggggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagcaacatgaaaacattctcctccgcataagcctgcgtcagattaaaacactgaactgacaattaacagcccaatatctacaatcaaccaa

SEQ ID NO: 51079 - DNA, 560 bp, Homo sapiens
  misc_feature 548: n = A,T,C or G
agcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagggaaagaatcttattaaatgngaaaaaaaaaaa

SEQ ID NO: 51080 - DNA, 188 bp, Homo sapiens
ctctacaaaaaatacaaaagattagctggtagtggcgtgtgctggtagtcccagctactctggaggctacagtgagaagatcatctgaacccgagaggttgaggctacagtaagctgtgattgcatcactgtactccagcctggatgatagagtgagatcttgtctcaaaaaaaaaaaaaaaaaaaaa

SEQ ID NO: 51081 - DNA, 450 bp, Homo sapiens
  misc_feature 28: n = A,T,C or G
ggcccagccaaacagttcgtgtgtgganaaaccttgaaattgctttgttttttgtgttatatgtgtaaacctgaatttgaggaagaatttataggaagaatttgtaaacctgaatttgtctctttgtaggtgatatatggaatctggagaggcaagcagctgctgtggttgcacaaaccccagttatctttagttttcttgtttccgacgcttccatgtagtatgacatatgcccatcttagaaatgtgacatggggtttccttatggagttcggagcctaagtgggggatttgcatttaaggcatcccttcccccaactttttaaaatacatgtggtcagaaaagattaggctcataggcatttgaccggagaggaaaaaggcacgtaccctctgggttcctgggtgaaacaatgtcccattgtttggtagccagtgaaacctcttttc

SEQ ID NO: 51082 - DNA, 197 bp, Homo sapiens
aaggtcagatgtgcaggccatcatgaagtgagtgtcgagggtggtgtcatcctgaaggttaacactgtagcggggagagcatggggttgcgtgtccctctccctccttgtgcaataactatcgtgggtaattcttttatcgtcttttagataatttttacatccacaaatcagaaaaaaaaaaaaaaaaaaaaaaaa

SEQ ID NO: 51083 - DNA, 440 bp, Homo sapiens
caaactaaaaaacatatggatacacaaaaaataaaaataaaataaaataaattatatcaccagagaaagtcaccttcagtaaagaaagacagcaagaaaaggaagaagaaagggaagatcacagaacaaccggaacgcaaatatcaaactgacatgagtaagttcttatttatcaataataacatcaaatgtaaatggactaaactcctgaatcaaaagatgtagagaggctgattggatgaaaaaagaagatccattgatcggttgcttacatgaaacacacattacctataaagacacacatagtctgaaaatgaagggatggaaaaagatattcaatgccaatggaaaccaaaaaagagcaagaatagctatacttacatcagacaaaatagatttcaagataaaaactgtaagaagaaacacagatcactataaaa

SEQ ID NO: 51084 - DNA, 203 bp, Homo sapiens
cattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacaaaaaaaaaaaaaaaaaaaa

SEQ ID NO: 51085 - DNA, 440 bp, Homo sapiens
  misc_feature 15, 32: n = A,T,C or G
atgggcaacctaagncgtgggtggccaacatnatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaag

SEQ ID NO: 51086 - DNA, 296 bp, Homo sapiens
  misc_feature 22, 275: n = A,T,C or G
taggcctaaagcgccccaattnagaaagcgttcaagctcaacacccactacctaaaaaatcccaaacatataactgaactcctcacacccaattggaccaatctatcaccctatagaagaactaatgttaggtataagtaacatgaaaacattctcctccgcataagcctgcgtcagattaaaacactgaactgacaattaacagcccaatatctacaatcaaccaacaagtcattattaccctcactgtcaacccaacacaggcatgctcatangggaaaaaaaaaaaaaaaaaa

SEQ ID NO: 51087 - DNA, 413 bp, Homo sapiens
  misc_feature 50, 203: n = A,T,C or G
gcaattatcaatgtaaagtacatttgaatgcttattaaaactttcccaantaattttaactgtgttattgaatttacttttactaaactactgttctctttgtctcttttttaactaggctctgattttgacccctaatttaagctttaagaatagaaatcagctaatatagaatcagacaaaaaggggattaaatgagcagnttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgccttttttttttttttta

SEQ ID NO: 51088 - DNA, 337 bp, Homo sapiens
tactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgtgcacttgcttaactctgaatatttcatttcaaaggtgctaaaatctgaaatctgct

SEQ ID NO: 51089 - DNA, 435 bp, Homo sapiens
gcctgaagatactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgcatttggtaacactgtgcacaaacgtttatactaaataaatatcaaactacattcttctg

SEQ ID NO: 51090 - DNA, 443 bp, Homo sapiens
  misc_feature 372: n = A,T,C or G
atgatgtaactgcatttgacctaaccactgcgaaaattcattccgctgtaatgttttcacaatatttaaagcagaagcaccgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgcagttatcataggctgttttaagttagaaaactgaatagcacactgaatactgtaagaaatgcactttgctcagtaatacttgagttgttgcaatatttgattatccatttggtngtacagaaaaatctaactgtaattgatgggtggttgccgtaatagtatattgctgtatttctacctctagt

SEQ ID NO: 51091 - DNA, 252 bp, Homo sapiens
tatggacacatgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagcccttttcaaaaaataataaatttcctgtgaag

SEQ ID NO: 51092 - DNA, 199 bp, Homo sapiens
  misc_feature 5: n = A,T,C or G
aaggnaaatgtctttccttttgctcttaagttgtggagagtgcaacagtagcataggaccctaccctctgggccaagtcaaagacattctgacatcttagtatttgcatattcttatgtgtgtgaaagttacaaattgcttgaaagaaaatatgcatctaataaaaaacaccttctaaaataaaaaaaaaaaaaaaaaa

SEQ ID NO: 51093 - DNA, 370 bp, Homo sapiens
atttttaagctttgcttctgttttccctacctagaatgtcagatgtttttcagttatctccccatttgtcaaagttgacctcaagataacatttttcattaaagcatctgagatctaagaacacaattattattctaacaatgattattaagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatccaaaaaaaaaaaaaaaa

SEQ ID NO: 51094 - DNA, 337 bp, Homo sapiens
ggagcccagtgacaccatcgaatttgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtggaaaaaaaaa

SEQ ID NO: 51095 - DNA, 330 bp, Homo sapiens
  misc_feature 14, 102, 307: n = A,T,C or G
atcctactccaagnataagcatttgcgtttggatggcaatcgcatctcagaaaccagtcttccaccggatatgtatgaatgtctacgtgttgctaacgaagncactcttaattaatatctgtatcctggaacaatattttatggttatgtttttctgtgtgtcagttttcatagtatccatattttattactggttattacttccatgaattttaaaatctgagggaaatgttttgtaaacatttattttttttaaagaaaagatgaaaggcaggcctatttcattacaagaacacacacatatacncgaatagacatcaaactcaatgc

SEQ ID NO: 51096 - DNA, 510 bp, Homo sapiens
  misc_feature 16, 23: n = A,T,C or G
agatttactcctagtntcagtgngacccccatgaagtcagccagaaagcctatatccaacttatgtacctttgcaaacttgtctggattttgactgtatgtgcaaaacagattgtacttagcgattcattaaacatcttttgatcatctgctgtctgccaggcactgtgctaggcatctgaaaaacaaagatggtccctgcagtttaatgtgaagagctatcttaattgtattccacaagtgtattggtcgtatctttgttttggtgtttctacctaaataaattttatattaactaaatggatactgttaggtggaaaaatgcatgtttaagaaagatattgctgttattttattaaaatacaaatatataaagaaaaattttccacttaatactgtattctagggatttatattctgtatatagttaacacattttagacaatgaaaatagcctatgtggttgcctttgctggatttttattgctaaccgtaattcttttaagatgac

SEQ ID NO: 51097 - DNA, 510 bp, Homo sapiens
tattcctgagctttttgtgtatacacaatcccaaactggaagaaattttaaaaaaaaggaatcctgctgtgaaaggtatatattactctagatttttcttactgtaaatattgtaagattgtaatactgtcgatattttattaaccaacaaatgttaatctatgtgaaatcagacttattttaaatgtgcttcttatttactgtgtgtggtccctgttgctgacagtattaagttatattctgatgtaagattaactttattaaagaatgtaaacattaatgtttccttatgggaaaacaaataaagtataaagaagacaattcttttcattgaaatatactgtgtatttacacttgctagacccagcaccacttataaatttagtacactgttcagaattttagttaacacagctgacatggttgtgctctgtttgaaagtctaagaataggtattgttggaatatacagtttgtatttgtctgctgtgaatcataatcttgaaatttc

SEQ ID NO: 51098 - DNA, 100 bp, Homo sapiens
  misc_feature 4, 16, 19, 79, 88: n = A,T,C or G
tacnactacttacacnaantatagtctataggttacgtaagatattgcttatgcgcgtaagtttttaacgtaattttantacgcttangattttaagaga

SEQ ID NO: 51099 - DNA, 440 bp, Homo sapiens
  misc_feature 4, 30: n = A,T,C or G
tggncaaagttattattttgcaacatctangctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcggcatttaa

SEQ ID NO: 51100 - DNA, 400 bp, Homo sapiens
  misc_feature 55, 97, 148, 151, 274: n = A,T,C or G
attttttttttaaacaaattaagtgtgtttagagtcattcctctacatgggctgnggctgtcagcccataggtttgtcagtttcacatcaaaactgngggtataaactgttgaaaccaatcacattaaaatatttagctgggcacagnggngtgcatctgtagtcccagctacttgggaggctgaggcaggaggatcgcttaagcacaggagttggaatccagcctgagcaacagagcaaaaccccgtctctaaaatacaaataaaatatttgngtagtttttgattaaaattgactacagcggtcagtataaaatacatgtcgcttttaaggaagtgctctttatgtatctaacagatggaagtttttgcattggtaagagcatttatatatgctttgt

SEQ ID NO: 51101 - DNA, 445 bp, Homo sapiens
  misc_feature 19: n = A,T,C or G
ggtcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaaaaaaaaaaaaaaaaaaa

SEQ ID NO: 51102 - DNA, 500 bp, Homo sapiens
  misc_feature 20: n = A,T,C or G
tgtataaacacatgagcagnaacaagttgttaatgcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatggtgatgatgaggacaactctctttttccaacaagagagccaagaagccatttttttccatttgatctgt

SEQ ID NO: 51103 - DNA, 461 bp, Homo sapiens
  misc_feature 22, 297, 326, 360: n = A,T,C or G
ctgcaacgcagagaaactatgnaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggngtcttttatatttggaattaagtaactgnatgaagtcatagataatagtacatgtcaccttangtagtaggaagaattacaatttctttaaatcatttatctggattttaaggttattaagcatttcaagaagacggatatctagagaataatcatatatatgc

SEQ ID NO: 51104 - DNA, 467 bp, Homo sapiens
  misc_feature 16, 308, 357: n = A,T,C or G
gagatcacgccattgntctctagcctgggcaacaagagcgaaactccggctcaacaacaacaacaaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgngggatctagtgggataatgagcactgacagaactcttaacagcggctgnatttttggcattgaaatgtaatgacttgatttgacataactctgtactaggtgaaagtagatcacagctggcatttaccaaatggttttggaccctaaaaattctgcatt

SEQ ID NO: 51105 - DNA, 373 bp, Homo sapiens
  misc_feature 31, 36, 116, 261, 268, 328, 354: n = A,T,C or G
gcttaacttcttatataatttaggtataaantctgngacatgctcttgagctttaccctagttgaacatacatgtgtagatttacacatactgtttcattctaaaatttagaaatngttcattaaatcccatttgaggtataagtcactcaggaagttaaaatatctctacacgtatatttttacattaaaaatacagtgttagcataaatccccttttcaggaagacaaaaatgtcagtgcataggtagataaaatggtnaaatgtnttactggaagcatacttttttgggaaatagatcatgaagcccttaaagtgctgcttctgncagtcaaacgttaaaaactttaacantttcaaagggcccagactg

SEQ ID NO: 51106 - DNA, 353 bp, Homo sapiens
  misc_feature 138, 176, 187, 219: n = A,T,C or G
aagcaaatttcctgaattgctatgtgctgggtttcatccatccgacattgaagtgacttactgaataacggagagagaatcgaaaaagtggccattcaagacttgtctttcatcaaggctggactttctatctcttgnactacactgaattcacccccactgaaaaagatgagtangcctgccgtgngaaccatgtgactttgtccagcccaagatagntaagtgggatcgagacatgtaagcagcatcatggagggttgaagatgccgcatttggattggatgaattccaaattctgcttgcttgctttttaatattgatatgcttatacacttacctttatgcacaaaatg

SEQ ID NO: 51107 - DNA, 182 bp, Homo sapiens
gtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttttccagca

SEQ ID NO: 51108 - DNA, 217 bp, Homo sapiens
  misc_feature 174, 177: n = A,T,C or G
ctcacagaaatatctgtacagccatgctcatagcagccatgtacaatagacaagagatggaagcaagccacatgtccatacatagagaaatggataaacaaaatgaatacatgcatatatggaagccaggcacagtgctcatgcctgtaatcccacactttgggaggccaaggnggnagaatcacttgaggccaggaccagcctgacaacagcaaga

SEQ ID NO: 51109 - DNA, 398 bp, Homo sapiens
  misc_feature 31, 177: n = A,T,C or G
tgggtacttctgcccctagtcaccatggccnggggccagtatggcgattatggatacccataccagcagtatcatgactacagcgatgatgtgtgggtgaatttgaaccggcaaggcttcagctaccagtgtccccaggggcaggtgataggggccgtgaggagcatcttcagcaangaaggaaggttctgacagacaatggaactacgcctgcatgcccacaccacagagcctcggggaacccacggagtgctggtgggaggagatcaacagggctggcatggaatggtaccagacgtgctccaacaatggctggtggcaggattccagagccgctactttgagtcaagtgctggatcgggagtggcagttttactggttgtcgctacagcaagagg

SEQ ID NO: 51110 - DNA, 146 bp, Homo sapiens
attatatttatgttgttgaacttatatatgaaataagtaaatgtagctcccacagggtaaacttcattggtaagattgcactgttctgattatgtaagcatttgtacatcttctttggaaataaaagataaaagagcgatacacat

SEQ ID NO: 51111 - DNA, 357 bp, Homo sapiens
  misc_feature 61, 62, 96, 197, 234, 304, 324, 327: n = A,T,C or G
tttctccacatcctcactaacacttgttattttctgttttctttaatttaaaattttaatnnggaaattatggccattgtagtggatataaagtgnatctcatggttttcatttgtatttctttgataatcaaagaaatttttttgttttctgttttctttaatttaaaattttaatttttaaattatggccattgnagtggatataaagtgttatctcatggttttcatttgnatttctttgataatcaaagattttgaacattttttcatgttttttatgttggcatttgtatatctactgngggggaaatgtctattcaanggncctttgcttattttttaattggaatggtgg

SEQ ID NO: 51112 - DNA, 380 bp, Homo sapiens
  misc_feature 33, 34, 35, 241, 254, 322, 347, 351: n = A,T,C or G
ttactctggatatatctaagcccttctgcacannntaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgnactgctggcctgnaccagaaacatttcttttattggtacttgcttttaaactttggttagccacttaaaatctggtatggnacaattgcctcaaaatccattccangtgnatatttgtttccaataaaaaaatacaatt

SEQ ID NO: 51113 - DNA, 227 bp, Homo sapiens
  misc_feature 32, 40, 66: n = A,T,C or G
gtgtagaagttaaggacatagaattggtcatnttacaagnaaatgtgtcgagagcaaaggcaggtngagccttgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgt

SEQ ID NO: 51114 - DNA, 541 bp, Homo sapiens
  misc_feature 54, 498: n = A,T,C or G
atccaatgtgaaatctctactcttgtatcctatgctggagaaggattagaaagnggatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggcttatttatataattttttccaagccaagggagaccattggccatccaggaaatttcgtacagctgaaatataggcaggatggtcaacatcagtttacttgcagctggaagcatttgttttggaagttgacataggaataatatggcattgnacatgtggaaaggttctatggactaaaagtttggttattttat

SEQ ID NO: 51115 - DNA, 189 bp, Homo sapiens
  misc_feature 24: n = A,T,C or G
cgcgcctgcctttcccattttgtntatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttt

SEQ ID NO: 51116 - DNA, 214 bp, Homo sapiens
  misc_feature 55, 56: n = A,T,C or G
gaacaggtaagttggatagggattctacccataagtatgttaaaatatatatgtnngtatgtgtgtgtgtgtataacttcatcgctagagatactatggagtgcttttaaaaaagtaaacctttattaaaatataacacatagagaattgtgcaagtggtaagtgcctaatgcagtttttctaagtgagcacttgtgagctagcacacagatca

SEQ ID NO: 51117 - DNA, 299 bp, Homo sapiens
  misc_feature 66, 67, 156, 221, 250: n = A,T,C or G
taaactttttcaaaataggtctctaaggaaaaccagcagaacattagcctgtgcaaaaccatctgnntggggagcacactcttccattatgcttggcacatagatctccctgtggtgggattttttttttccctttttttgtgggggagggttggnggtatatttttcccctcttttttccttcctctcctacatctcccttttcccccgatccaagttgnagatggaatagaagcccttgttgctgtanatgtccgtgcagtctggcagccttaagcccacctggcacttttagataa

SEQ ID NO: 51118 - DNA, 105 bp, Homo sapiens
  misc_feature 29, 61: n = A,T,C or G
atatgccctgaaacgtcaggggcgcactntgtatggcttcggcggctgaatctaagaatangcggtctcctgagaacttcaaaaatttcaaaataggaaaaataa

SEQ ID NO: 51119 - DNA, 353 bp, Homo sapiens
  misc_feature 30, 61: n = A,T,C or G
tgttgtaatttttggtaaccactcaaatantagtattgtaccaatctaagaaagggacaanttcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagcgaattttctgaatgtttttgtaaatggaagaaaaaaagaaggtaggaaa

SEQ ID NO: 51120 - DNA, 382 bp, Homo sapiens
  misc_feature 156, 201: n = A,T,C or G
tatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagnttcactctcttgacacacttattaggaagggattgcttcactggnttaataatttaaaagttatgtttgttaaacaccctgtcagaacagtcattttcagtattagattcctgtctattgtgttttgagtgtgttctggaaccttcatagaacacactttcttttggaatgtatttgattgataagaaagtttagacattggtttcactgcaatgtagaaatacag

SEQ ID NO: 51121 - DNA, 556 bp, Homo sapiens
  misc_feature 29, 63, 434: n = A,T,C or G
tcaaaaataaacctcttttcttttataanttagccacttgcaggtattccagtatagcagcgnaagaattgactaatatagtatcagagctaggattcaaacccgtgcctttgtgttctaggatttatgctttctctcctctactaaaactgcaggaatcagaggaatctaggggagaaacatggtatttgtgaattggtgagatatgaccatgcccagataggaaagatagacagaacagattcaataatgaaaataggaaaaagcagagtaaattttagacatttcttaaagaagatacaccagtggccaataagcacatgaaaagatgcccaacatcgttatagtcattatggaaatgcaaatcaaaaccatgagataccacttcataccatcaagaatggctataggaggatggatagaatcaatattgngaaaatgaccatactggcaaaagcaatctacaaattcacgcagtccccatcaaaatccaccatcattcttacagagttagaaaaaacaattctaaaattcatatggaatcaaaaaagagccc

SEQ ID NO: 51122 - DNA, 434 bp, Homo sapiens
  misc_feature 58, 268: n = A,T,C or G
tttatatttagactttaagctttgcttttcagattgttttataatagaatgtaatttntaaatctttttaaagatcacttaacatctttaccttggaaaaactttttagaagtttgctaaataaatatttgtgctactgttttttatattctataggtctttttaaaatcctataggtctttaaggcaatccagtatgaaaaaaagatcctctaagggttattttctttaacaaaatgcttatgataaaaaaaatataaataattggntttaaattataacttttgaagtaatatttattcaataaaaggagtagacctgacttcagtcttattttgagaaatgttgcttctcttccagtgtattaagtgattgggaatgtgatacacttggtaaggtaaaacagattttttaaccttctttagacatgatttg

SEQ ID NO: 51123 - DNA, 282 bp, Homo sapiens
agccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccccgaaaaaaaaaaa

SEQ ID NO: 51124 - DNA, 100 bp, Homo sapiens
actacaggaaactcgtctcttaatagcacaggtaacactaaagtatcagcagtgcctacaaatatggctgccaagaaaacatctacccccagaaaaaaaa

SEQ ID NO: 51125 - DNA, 347 bp, Homo sapiens
  misc_feature 52: n = A,T,C or G
gtagacagaataggataattaaacctctgtaatttctgtgagtttttcatgncgttttcccccctaagtaatgatgtcctggggtgcagtgttgttatacttcttggaagtaacaaaagatgagaaaaaggataggttgtttggggatagaatatcatgttgttaagagagaaagaagatagaagttacaagttctgttgactttcatcttctccatagggttgggggtggggtcttcaagcaggtagaaccaataacctgttaaggaaactccagcctaaggcaaggtgaggctcacacgtggccattacaagaccattctcaggctaagtgttgctaaaaaaaaa

SEQ ID NO: 51126 - DNA, 114 bp, Homo sapiens
  misc_feature 105: n = A,T,C or G
aaagtagacagaataggataattttaacctctgtaatttctgtgagtttttcatggggttttcccccctaagtaatgatgtcctggggtgcagtgttgttatacntcttggaag

SEQ ID NO: 51127 - DNA, 400 bp, Homo sapiens
  misc_feature 25, 272, 305, 327, 362: n = A,T,C or G
acaagtacataaatttgctttattnttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgaggtctttagtggcaatagaagggacttctatgctaaatacaaaactaaaaaggcaaaatantgaaccccaaattattttatttaaaatagcagnggattataaaattagcttgggngtacatttatgcccatttttggtgatagattggcnttacatttttaaaaaaatttatttaaaaatttatcaaa

SEQ ID NO: 51128 - DNA, 421 bp, Homo sapiens
  misc_feature 60, 73, 74: n = A,T,C or G
tgccctcccatacaggctggataaaactgtttttaagtcagagattttagactgacctcnatttaaattgtgnntatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaatggctgtaaattattgtaaatattaaaggaactttccttacttccttccctttctcaggctttttttgactgttcctttccctaccaactcaaggccttcttatta

SEQ ID NO: 51129 - DNA, 480 bp, Homo sapiens
  misc_feature 33: n = A,T,C or G
taagttggagctgtgagccagaggatgtcagcngccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttggtgatggttgcaaagcttgcttcactccatcagagaatgactatcaatttttttttaactgcctatcacgtcctctcctgtcacccattttgaagagtggcagaacttgaaggtcaacttcctctgtaatatccaagttaaagccaggaacttctagaataacccagatgcgcttaattttttttaa

SEQ ID NO: 51130 - DNA, 558 bp, Homo sapiens
  misc_feature 21, 54, 55, 462, 465: n = A,T,C or G
taagttttaatcagcttaaangctatttaacccattttaataagcttgcagtgnntgtttctctgcatatgatattcttattagaaaacagaagtagctaaaagtttattattttaatcctatttaaatgttctttcaaatctctaataatttaaactttcctcagtgctccatgatactttttttgagactccatatcattgcttattttacctttttcaatttagagggatttgttactagtcgatcaattagaatgaacctatgcacatttttatgtacacatatccagttatataattgcttcctagttgcattatatggcaaatgagattttgtacatggagttgacataatactttgtaaattgaattttttaaagaaataggcattggataaccagcttggcaaggtaactctactaacagatgtgggatagctatttaaagactacttcgaagnagnatgatattggataaatacacatggttaagttttaatacactgcatatgactcttctgcttctggaaagaaaaggtttttgcatgctaaaactg

SEQ ID NO: 51131 - DNA, 295 bp, Homo sapiens
  misc_feature 55: n = A,T,C or G
caacatggttctaaccttcagttctaaagaagatgcagtttcctttgcagaaaangaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactacaaaaaaaaaaaaaaa

SEQ ID NO: 51132 - DNA, 265 bp, Homo sapiens
  misc_feature 61: n = A,T,C or G
tgccctcttacgttgcatttcttcttttacaccactgttttacatgttgctcctccctggncattggttcctgttggcttttgttcttttacctgagttggaaatctgggaagacaattccaactcagtggtctgggcattctggtggtgctgccaaccccagggcaggaagaacagtgagtgagatactgtgccattacctgcttctccagccttgaagcccaaagcagccaaataactctcaaatgacgatcacttttactca

SEQ ID NO: 51133 - DNA, 135 bp, Homo sapiens
gagggttctgatgggggggctttggcaaaaatctttatgggggtggaaaactggaaaaaatacctcatccagatttcatattgtcttgacaagaactatgggcccctgtttttagaaattgggggaaaatgtttt

SEQ ID NO: 51134 - DNA, 463 bp, Homo sapiens
  misc_feature 62, 340, 386, 405: n = A,T,C or G
accaccgagtagagctacaaatgtcaaataattaccaacatttcggctgtggagatgacccnattacccagtaagcgaatatgtaaacctaggtggaaaacatgatttctaaatttgatgatctgatctgttcaatagttataataatcatattaaataattaccattataattgtgtttggcatgcatgggcattttgctcctgaggattagggggcagtgatttttattctggttgagtaatctctttcccctccaagttgcctgttagtcttggtgaatctgttctttcctcttcctagcatgcctccagtttaacagatgtggccctgtgtatctnctcagatggcttcaactgcagttggtgtagtaaacttcaaaggtcnaaatataataataagaatnataataaaattaaaaaagatattttaaaagattagaaattaaaaataccttaatgggc

SEQ ID NO: 51135 - DNA, 487 bp, Homo sapiens
  misc_feature 292, 433: n = A,T,C or G
ctccactgggaggagtgatactaggtgagtggatctcgaaatcgagattaagcaggatcgggctatcttttgaggatagggcttttctggagttttgcagtgtgagtagttctgtttaattgatgtggttcacttcctttcactgtttagcatcctggctcgtgtccattccaggctaggagccaagccacgctatctttatcatggtgtgttaaagaaatagctctagcacatgtgcagtgggaatgatggcacctgtcctacctgccccacagagttgactgaactgctnttttaaaaatcattggtattgataataatctttgttcaccacacatcttaagcagccattatacaattttttgagctgtggattaaaagccagaggattttagaagttgggtaaatatgaaaaatattctatttagaatgnatgggtatatttttttcccaatgttttaaagtttgggttaaaaatttactaagc

SEQ ID NO: 51136 - DNA, 319 bp, Homo sapiens
  misc_feature 62, 63: n = A,T,C or G
taatgtttacaaaacattttggtgaatttcctcaatgttttataaatgtacattttttaagnncttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatctaataaaaagaaaa

SEQ ID NO: 51137 - DNA, 260 bp, Homo sapiens
cctatcatctgtaggctcattcatttctctaacagcagtaatattaataattttcatgattggagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaa

SEQ ID NO: 51138 - DNA, 542 bp, Homo sapiens
  misc_feature 25, 461, 464, 500: n = A,T,C or G
tgaaaagcaaaatgggcatatcatntttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggaagtagatactggtctgtgattggtggaatggagaacacacgtgttggtgcttctgggtagcactgggtttgcattaagttatgtttccatgccaaaagttgtgtgggcgggccgcatgtgcaccacagagtgcactcgaggggactttcagtcacaggatttcataantgncaattggcacacttttcaaattttttgacatcaagngaaatttttttatattaaaaaggttgagccaaaagcccccaa

SEQ ID NO: 51139 - DNA, 150 bp, Homo sapiens
ttctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaaaa

SEQ ID NO: 51140 - DNA, 325 bp, Homo sapiens
  misc_feature 58, 59: n = A,T,C or G
aaacgtatgtaatatatattaaatttataaagcaaatttatgttgtgatcttgcctgnncaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtttttaaaagaa

SEQ ID NO: 51141 - DNA, 511 bp, Homo sapiens
  misc_feature 25, 47, 57: n = A,T,C or G
ttttaactacctcaactggtcaganacacagattgtattctatgagncccagaagangaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggcaacaataaaaaccaaattatggggctgcttttgcacactagcatagagaatgtgttgaaatttaactttggtaagcttggatg

SEQ ID NO: 51142 - DNA, 270 bp, Homo sapiens
  misc_feature 57: n = A,T,C or G
gggtcaccagcagctgtactggagccacccgcgaaaattcggccagggttctcgctnttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccaataaaaaaa

SEQ ID NO: 51143 - DNA, 486 bp, Homo sapiens
  misc_feature 27, 60: n = A,T,C or G
gacagcagttgtccgagaagtgacagntgtattactcagagcttttacttcttacacctngaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctacgccaagatgctggagcataatataagactgtatttggtgtgcttgttttgtttctttggtagagtttattaggtgaatcttctaaaactttccttctgttggatcccagtgacgtggaagtcatcagaaccccacggtacttgggagtacctctctgcaccaagatagctggctgatttctgctcagtcacaatttacttgaagcaagaattgtcctagctccttttcattattccaaaacggttaacgtcaaag

SEQ ID NO: 51144 - DNA, 628 bp, Homo sapiens
  misc_feature 58, 60, 544, 573: n = A,T,C or G
gcattcggccgagatgtctcgctccgtggccttagctgtgctcgcgctactctctctntntggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaagatgccgcatttggattggatgaattccaaattctgcttgcttgctttttaatattgatatgcttatacacttacactttatgcacaaaatggaagggtataataatgtaacatgggacatgacttcttataattctactttgagggcngctcatgtttgaggatctgacaggttgcnccacaggtagctctaggagggtggcaacttaaaagggggagcaaagaattttttt

SEQ ID NO: 51145 - DNA, 377 bp, Homo sapiens
  misc_feature 22, 53, 242, 254, 284, 290: n = A,T,C or G
gttatccgcgatgcgtttcctngcagctacattcctgctcctggcgctcagcngcgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggcccgtggtgcatggcatnctgatgggcgtnccagttccctttcccattcctgagcctganggttgnaagaagtggaattaactgccctatccaaaaagacaagacctatagctacctgaataaactaccagggaaaagcgaatatccctctat

SEQ ID NO: 51146 - DNA, 603 bp, Homo sapiens
  misc_feature 22, 23, 25, 55, 57, 497, 533, 562: n = A,T,C or G
tgaaagagatagagaaacaaanntnccttcaaaaaaatcaatgaatccaggagcngntttttgaaaagatcaacaaaattgatagaccagtagcaagaataataaagaagaaaagagagaagaatcaaatagatgcaataaaaaatgataaaagggatatcaccaccgatcacacagaaatacaaactaccatcagagaatactataaacatctctacacaaataaactagaaaatcttgaagaaatggataaattcctctacacatacaccctcccaagactaaaccaggaagaagttgaatctctgaatagaccaataacaggctctgaaattgaggcaataattaatagcctaccaatgaaaaaatagtccagaaccagatggattcacagccagattctaccagaggtataaagaggagctggtaccattccttctgaaactattccaatcaatagaaaaagagggaatcctctctaactcattttatgaggncagcatcatcctgatactaaagtctgggcagagccncaacaaaaaagagaattttagccaatatncctggtgaatattgatgcagaaatccttaataaaatccggg

SEQ ID NO: 51147 - DNA, 242 bp, Homo sapiens
tcatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttcaaaaaaaaaaa

SEQ ID NO: 51148 - DNA, 224 bp, Homo sapiens
gtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccataaaaaaaa

SEQ ID NO: 51149 - DNA, 195 bp, Homo sapiens
atgacgactatttgcagttttcttaaataggtaaatgattaaaataaaataattagttaaatgtaatggaataaatacttatagacaaacttgtcataatttagaatgtaaagttaaatacatatttcattaaatgtttggatattttccaattaaaaaattatattgtaggaaaacattgtttccaaaaaaaaa

SEQ ID NO: 51150 - DNA, 464 bp, Homo sapiens
  misc_feature 53, 421: n = A,T,C or G
taaatgggccaaagtgtactttgagactggcagccatctatggtaccactganaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagatggtctttacctaaggctgngtttcctaagctctgaagtttaagcaccagtagatttgttttt

SEQ ID NO: 51151 - DNA, 254 bp, Homo sapiens
ttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaaatcaaaataaaaattaaatgtgagcaaagaat

SEQ ID NO: 51152 - DNA, 527 bp, Homo sapiens
  misc_feature 31, 397, 478: n = A,T,C or G
gtgcaggtcctgaaacgcgggctgcagcttnatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatggtcctccaacaacaaaaccacttactgctcgtaaattcatttggacgaaccataaattcaacgtgactgggaccccagaacaatatgtaccttattctaccactagaaagaagattcanggagtggatcccaccttcaacaccttacaagtaaagacaatgaagaacagttgaacatgcaaaatatggagcttttcatgnaattactcttttactggttacccattactttaattccaattaaaattgg

SEQ ID NO: 51153 - DNA, 362 bp, Homo sapiens
  misc_feature 21, 47: n = A,T,C or G
tacatgtgaggttttcttttncttgagtggacagtagcacctgtatnattgggctcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcgcccgtta

SEQ ID NO: 51154 - DNA, 389 bp, Homo sapiens
  misc_feature 28, 110: n = A,T,C or G
gataccttaagtatcacataccctgatngggtaaagaatcagtatcttttatcctatctatggaaaatataatgattgatgataagtttatgagccattgtactaatttnaatcgacacatccgctcctctatagcacacttccttgagataaaactggctaatagtatcaactgacctgttttctgttttttcattgaactttaaaatgtaattctttttctttttctggtgctcaaagagatacatttgtttgagtccttgtgtattttatgtatcacattaagaaaattataaagaacttaaaagcttaaggcaaactttaaaaagtgcttgcaaggttagatttctctttcctttcaactaaaaaacaaaaaaaaaaaagggggg

SEQ ID NO: 51155 - DNA, 153 bp, Homo sapiens
  misc_feature 63: n = A,T,C or G
tcaagcaagatttaatcatgaagagattttctatctgtctgatgtatctggggtagttgtggnttgctgttaatggttaagcagtgtaccaccaatctaccattaaaatattttttgctgacaattttgtattaaaattacagaaaaaaaaaa

SEQ ID NO: 51156 - DNA, 493 bp, Homo sapiens
  misc_feature 27, 60, 61, 63, 413, 466: n = A,T,C or G
tgagatgatatggtgagtagaaatganttttaatgatgagacgaaatgacaaaattgaanngnaattgaaaggagatgagatgagataaaatgagatgaaatgatgagatgatggatgaaatgatgagatgaaatgatgagatgaaatgaaatgaaataatgaaatgatatgaaataatgaaattgaaatgagatgagatgagatgaaatgagataaaatgatgagatgaaatgagatgaacgatgagatgaaatgatgagatgaaatgagatgaaaaatgatgagatgaaaaatgagatgaaatgaaataatgaaatgagatgaaatgaaatgaagtaatgaaaggaaattatgaaatgtaatgatgaattggaatgaaattggaaatgagatgatttgacatgatgagatntaatgatgaattgaatgatgaatgagatgagataaaatggggatgaatattgngatggaatgggatatggggattggttg

SEQ ID NO: 51157 - DNA, 389 bp, Homo sapiens
  misc_feature 18: n = A,T,C or G
gcggcgtttccactctcnttttcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttctgaagatctctaccatttaattaagaaagcagttgctgttcgaaagcatcttgagaggaacagaaaggataaggatgctaaaattccg

SEQ ID NO: 51158 - DNA, 483 bp, Homo sapiens
  misc_feature 57, 59, 274: n = A,T,C or G
aaagtataaaatgtttgttgaagttttttattttagaatgaatggagaaatgccaangntgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgntaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatatttagtgggctattataaatagtct

SEQ ID NO: 51159 - DNA, 490 bp, Homo sapiens
  misc_feature 70, 465: n = A,T,C or G
ggccactgcgcagaccagacttcgctcgtactcgtttgcctcgcttcgcttttcctccgcaaccatgggntgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgctttcccatctgtctatctatctggctggcagggaaggaaagaacttgcatgttggtgaaggaagaagtggggtggaagaagtggggtgggacgacagngaaatctagagtaaaaccaagctgg

SEQ ID NO: 51160 - DNA, 167 bp, Homo sapiens
  misc_feature 34: n = A,T,C or G
agatgctgagtgaattcacagttctcagcttttntgccactttctgactaagtcttgaggatacacacttgtggtcttgagttcaggcatagagggaagcatagaccattttctgttgctccttatggctttatttatgttaagatttgtttgaaaaaaaaaaaaaa

SEQ ID NO: 51161 - DNA, 361 bp, Homo sapiens
  misc_feature 28, 58, 69: n = A,T,C or G
gcacatccttgctaatttcaaaaacttncagttctttattggtgaaaacatgaatccngatggcatggntgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacgcat

SEQ ID NO: 51162 - DNA, 354 bp, Homo sapiens
  misc_feature 53: n = A,T,C or G
caaagctcaccctcccgagttgaaaaaatttatggacaagaagttatcattgnaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgtcagcagagaaacccatgtcctctctccatagggcctgttttactatgatgtaaaaattaggtcatgtacattttcatattaagactttttgggtaaataaacttttgtaatagtccc

SEQ ID NO: 51163 - DNA, 185 bp, Homo sapiens
  misc_feature 21, 22, 54: n = A,T,C or G
ttttcttactatctataaaanngacgaggcagggatgctgtgttctttctgtcnaattctaaatgtgatctttgccattgcttatttgaattcaagaaagctatactttttcatcacatataactcacagtttcatttttgcattgttggattagacttaataaaacctaaatgggaaaaaaaaa

SEQ ID NO: 51164 - DNA, 467 bp, Homo sapiens
  misc_feature 424: n = A,T,C or G
tggtggctaggtcggttctctcctttccagtcggagacctctgccgcaaacatgctccgcagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtcagatttctaaatgaaatgtttcactataacgctgctttagaatgaaggtcttccagaagccacatccgcacaattttccacttaaccaggaaatatttctcctctaaatgcatgaaatcatgttggagatctctattgnaatctctattggagattacaatgattaaatcaataaatacccc

SEQ ID NO: 51165 - DNA, 527 bp, Homo sapiens
  misc_feature 51, 391, 465, 489: n = A,T,C or G
tactagagatgcttctagtagaccttaatctagcatagttgaacctctgantatgtgaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggcctttaaaagcttgcagagttgcacaaatctaactggtattttgtttttgtttttaggaggagatgttaaagtaacccatcttgcaggacgacattgaagattggcttctgttgatctaagatgattattttgtaaaagactttctagtgacaagacaccattgngtccaactgtatatagctgccaataggtttcttggttttactttggccttgctatccggggtatgactcaatgnggatttggttatacacatttattngataatttatgtaaacctcaaataaatgcttcctttgt

SEQ ID NO: 51166 - DNA, 492 bp, Homo sapiens
  misc_feature 45, 65: n = A,T,C or G
tcaggtctaagcggtgtgcccgtggaaagtttggttccgcagccngccggatcccccagtccagngcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggttttggtttcataagccttttaaattttacctgaaagaaagggtacccagtgggttgaacaaattcaagagttggttctacgcttctggtgagaagaactgtgaaaaggagcatggttgaacagctg

SEQ ID NO: 51167 - DNA, 103 bp, Homo sapiens
tgtagtcatcttaaaggcttctcatccactgtgcttcttaatgtgtaattaaagtgaggagaaattaaatactctgagggcgttttatataataaattccaaa

SEQ ID NO: 51168 - DNA, 136 bp, Homo sapiens
  misc_feature 76: n = A,T,C or G
catttatcaagatcaaaaccaacccggtttcttttactgatttaaaaacaaaacaaaaaaaaaagggaaaagttgngcctgaaatgaatcttgtttttttttataagaagccgcctggttactgggtcctgtaaaa

SEQ ID NO: 51169 - DNA, 435 bp, Homo sapiens
  misc_feature 28, 339: n = A,T,C or G
cttttgcccaaactcacccagtgagtgngagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgggatgatctggtactgcaacttcagcgaattgctctgctgccaaaagacgntttctttggccaaagatctctttcgtgattccttgcaacaatcaatgagaatcttcatgtattctggagaacaccattcctgatttccacaaactg

SEQ ID NO: 51170 - DNA, 455 bp, Homo sapiens
  misc_feature 60, 129, 333, 383: n = A,T,C or G
atctcatttttgggacctcccatctttctgttttgaaaagtgtacagtagtgcagtgtgnctgatgtaactttatggcttacaatgttgacatgtctcaggttcatgtgtttcgattggtgttttccgnctcaggtaggttgcaaagtgtaggccccacacattggaaaaaaataataataaaacaaagcaaaaacaggaaattatggattttagttgtatattggttatgtattttttcttaagtatacagtgcactgtttgaaatgtattgttgagtattactttgtacaggttgatcactttttttagagtgaagaaagacaaacctggntttttgtgttttttaaaggaatataaaaataaatgaagggatgtataatntgatgccaaataagcttggtctttagtcacaccgacgtcttaatttttccctttaggccagttctgttttaa

SEQ ID NO: 51171 - DNA, 293 bp, Homo sapiens
gttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagggaaatgactgagatgaatgtctttactaaagtaccaataaatttgtcaaactaaaaaaacca

SEQ ID NO: 51172 - DNA, 365 bp, Homo sapiens
  misc_feature 26, 27: n = A,T,C or G
tggaccagtgtagagatggcaaagtnngcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatcccttgcctcaataaataaagttcttttttagttccgaa

SEQ ID NO: 51173 - DNA, 384 bp, Homo sapiens
  misc_feature 3, 5, 12, 17, 19, 21, 35, 36, 40, 53, 60, 62, 65, 80, 86,105, 126, 212, 311, 338: n = A,T,C or G
ggngntctgatncctcntncnggaacccggccatnntggncgaagattccaantgtggtntntgncttattcatcatttntaaggnttatctaattaactgtgtntggaactgctataaatacatnaacaaccgaaacgtgccggagattgctgtgtaccctgcctttgaagcacctcctcagtacgttttgccaacctatgaaatggccgngaaaatgcctgaaaaagaaccaccacctccttacttacctgcctgaagaaattctgcctttgacaataaatcctataccagctttttgtttgtttatgntacagaatgctgcaattcagggctctncaaacttgtttgatataaaatatgttgtcttttgtttaagcattta

SEQ ID NO: 51174 - DNA, 358 bp, Homo sapiens
  misc_feature 19, 20, 53: n = A,T,C or G
ccaaaattttaagtagganngtcacccaaacacttctgctttcacttaagtgnctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactggtttaataaaagatttacattcctcaaaaaa

SEQ ID NO: 51175 - DNA, 253 bp, Homo sapiens
  misc_feature 24: n = A,T,C or G
actcccaagaagaataagcacatnagaaagaaggttaagctgactgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactagaaaaaaaaaa

SEQ ID NO: 51176 - DNA, 338 bp, Homo sapiens
  misc_feature 28, 30: n = A,T,C or G
ttgtttataataaaaatcatctatacantnagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttgggtgcctcttggctatataacttctgagtgcaaatcattgaacactttaacgaagtattgtagagaataaatcataatggctaatatagcaca

SEQ ID NO: 51177 - DNA, 471 bp, Homo sapiens
  misc_feature 30, 62: n = A,T,C or G
agccgtgtcttcggaataatttattttaantatgcttttctccctccttattcatccagctnctgagcagccgtgcttaagttcaagaccatatagattaaaaccttaattatttttctttagaaaaggtcactaaacccagaaatgctttagaatccttttgaggcctgaagatagatgaagcattgagaacaaacctgacttggaaaacagacttttcctggatttagaaacatatttgcacctgtgtcactaacattgcacccttcataacatttacaaaaatatttttcaaggtgctacatgattagaaaatcatttttattcacaaatatagcacagaaaacgtttatgcaagttatttaaaagccacacaagtaaagaaatccatttaactgcctcaggcaaaaggctataacattgtattttggaaatttgatagcaacaaaataaaaactggtcttaagcaaa

SEQ ID NO: 51178 - DNA, 210 bp, Homo sapiens
  misc_feature 55: n = A,T,C or G
ataaaatatttaaaattatttaaattgttttggacgcttcaattgtattatatgngatttacatttcactttttttgttggcggttgttaacccggagagtgctcctgtattgaactttgctgttagttattttattgcttctttttggagagtgctataaaagactattctaatgaaaacattaaaatttacaatttgacataaaaaaa

SEQ ID NO: 51179 - DNA, 147 bp, Homo sapiens
  misc_feature 14, 43, 114, 120: n = A,T,C or G
aactcaacgtgccngagctgagtggtccttgacgagacactgnccccactttcaagcctggaggaagcatgcacacatggagacggccctgctgtagatgtttggatcttcganatctcnccaggcatcttgtctcccacaggatcg

SEQ ID NO: 51180 - DNA, 276 bp, Homo sapiens
aaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctaggcagagaacccaggatgg

SEQ ID NO: 51181 - DNA, 426 bp, Homo sapiens
gaaatatttttaaagccacaattattttaatattggatatcaactgcttgtaaaggtgctcctgttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattcaaaattcc

SEQ ID NO: 51182 - DNA, 109 bp, Homo sapiens
ggcctgttacggttgtgattggcggggtgggtttaggtaattgttgagtttatgattgcagataaactcatgccagagaacttaaagtcttagaatggaaaaaaaaaaa

SEQ ID NO: 51183 - DNA, 427 bp, Homo sapiens
  misc_feature 22: n = A,T,C or G
gccatccaccttcagatgtgtntacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgcattttcagaatcatcttttgaagctttctgttgatgttaactgagctactagagatattcttatttcactaaatgtaaaatttggagtaaatatatatgtcaatatttagtaaagcttttcttttttaatttccgggaaaaaataaaaagagtatgagtcttctgtaattcattgagcag

SEQ ID NO: 51184 - DNA, 487 bp, Homo sapiens
  misc_feature 49, 50, 112: n = A,T,C or G
aacacaggccttatttgcatgtatctgtgatcaagatattgaatatctnntagtctcagtggcttcacctgtgaaatgagatactgttattcctacatgataaaggtgttgngaggattaaatgacatggcacacacgaaatactcagcgtagtgtaagcattcagcctcattagctgttatattcatcattatctcctagattcaagggtataaaactggcaaagagcctatccatatttcaagttagcaagtaactttcttggatgcagaaattatattctgcagtataaaggtttaaggcaaatagagaaattcatcttaattcaagtttcggttgacacctttggaagccaagtcctcatatttaatgcaagcagaacgtctttatgaaaacaaaatatcccttaagtataaaaatcttttcttctgaatgcagattacaaaaatgtatgttcaattcttactaaaaatacaaataatctatg

SEQ ID NO: 51185 - DNA, 592 bp, Homo sapiens
  misc_feature 471, 495: n = A,T,C or G
agataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggttgggatcaataggaaagcatatgcagccaaccaagatgcaaatgttttgaaatgatatgaccaaaattttaagtaggaaaggtcacccaaacacttntgctttacttaagtgctggcccgnaatactgtaggaacaagcatggacttggtactgggatattttaaatattcacaggactcacttttttccaaaggatctagtaattggctaaaaaaat

SEQ ID NO: 51186 - DNA, 262 bp, Homo sapiens
ataaaccaaatatgttaaagtttaagtgtgcagccatagtttgggtatttttgggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattccaaaaaaaaa

SEQ ID NO: 51187 - DNA, 330 bp, Homo sapiens
gttcatgctacgttacggtgtttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgcaaaaaaaaaaa

SEQ ID NO: 51188 - DNA, 484 bp, Homo sapiens
  misc_feature 18: n = A,T,C or G
tcgggccttacgaggatnctaaggctgcgttggggagaggccctcacttgatccggcgactagcaccgcgtccggcagcgccaagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcataggccctggcaacgtcaacattgggagcctcatctgcaatgtaggggccggtggacctgctccagcagctggtgctgcaccagcaggaggtcctgcccctccactgctgctgctccagctgaggagaagaaagtggaagcaaagaaagaagaatccgaggaagctgatgatgacatgggctttgggcttttttgactaaacctcttttaataacatgtcaataaaaaagctgacc

SEQ ID NO: 51189 - DNA, 196 bp, Homo sapiens
gtgactcgaggtgtttaagaaaattaattttatgatggtgaaaaaatgcaattttcagtagcaaagtctgaattgcatagattcttaaataaatattgcttgcagtaacaaaaggaatgagtattctccatatcaattattaacaatactcatgaacaaggttaagaaaataacaccaaaattaaatgtgcccaga

SEQ ID NO: 51190 - DNA, 400 bp, Homo sapiens
  misc_feature 9, 11: n = A,T,C or G
gccattatntncgggggtcagaacggccgatctccagcccaagatgattccagcagtggtcttgctcttactccttttggttgaacaagcagcggcctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggcatattcttctttggcttctggtcttccagccctcatggttggcatcacatatgcctgcatgccattaacaccagctggc

SEQ ID NO: 51191 - DNA, 157 bp, Homo sapiens
  misc_feature 16, 40, 41, 44, 49, 67, 73, 81, 84, 111, 119, 137: n = A,T,C or G
acttactatgaatatnggagactccccactatagcacaanntanaattnaagtcttactatttagangtaggngggggccnctnaatttactctacattgaaggtttttanttcttagnatctgaacactttagaantaaactctcttggagagaaa

SEQ ID NO: 51192 - DNA, 128 bp, Homo sapiens
  misc_feature 25, 27, 74, 108, 109: n = A,T,C or G
aatccgcttatttcggggaggcatncnggcagccagcgcaggggcttctgctgagggggcaggcggagcttgangaaaccgcagataagtttttttctctttgaaagnnagagattaatacaactact

SEQ ID NO: 51193 - DNA, 395 bp, Homo sapiens
  misc_feature 1, 91, 334: n = A,T,C or G
nggatggcccggagatggagatgatatggaaatattcatggaggagatgagagaaatcagaagaaaacttagggagctgcagttgaggaantgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagngtaagtttctgcagcagtagtttcacccatttgcatggaaaaatttaaagctaataaagca

SEQ ID NO: 51194 - DNA, 188 bp, Homo sapiens
  misc_feature 9, 11, 133: n = A,T,C or G
acgtcattncnggctcaactttcctcactatctgcttcatccgccaactaatatttcactttacatccaaacatcactttggcttcgaagccgccgcctgatactggcattttgtagatgtggtttgactatntctgtatgtctccatctattgatgagggtcttaaaaaaaaaaaaaaaaaaaaaaa

SEQ ID NO: 51195 - DNA, 281 bp, Homo sapiens
gcctttaccaggaaggacgttggtgttgagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttc

SEQ ID NO: 51196 - DNA, 400 bp, Homo sapiens
  misc_feature 9, 25, 81: n = A,T,C or G
gagaattcngccttattttcggggncttgtcgccaggaaggatgcagaggctgtgtggtttaccaaaatgccttaacttancagtgaatgacaactgtcaaaacacatgttgagggaaaatttttactgattcacaaaaaggaagacaggtttgcccactcttagtggcacaaatcaaagctgcatgcactacattatccaaattaagtcgtaaccaaatagttaaaaaattctgctgggcacggtggctcatacctgtaatcccagcactttgggaggccgaggcagttggatcacctgaggttaggagtttgagaccagcctgccaacagggtgaaaccctgtctcgtctaaaaatacaaaaattagccggcgtggtggtgcatgcctgtagtcccag

SEQ ID NO: 51197 - DNA, 388 bp, Homo sapiens
gatgtctcatctccattggtgccactttcgtgtcctcttaaagtgagtcctcaaatttgtttctgtaatctaaataattaatcatagaaactaactgttctttttaggaaaaaatgcttcaaatcatataaatgtacagttctatgattatcaggttgcatttaattagatgtttagagtatcattttattgacttttgacagttatttgctttcccttctctaagtaacactaacacgagcagctaatatttctagcattgattgtgtgcctggctctgttaaaggccttaaatatattatctcatatactctacccaacagtcctatgatgtatgggaccataattattctcatgttactgatgaacaaactgaggtttggaaagg

SEQ ID NO: 51198 - DNA, 245 bp, Homo sapiens
  misc_feature 3, 8: n = A,T,C or G
agntgacntgtgtgacaggcgacacatttttcactgttgaatgctttggaaagaagtgataaaagcaagccaccaaaagggaattgctgccaaattaggtgtgagcaagacaactattaaagactggcactgtggtgccgtggctcacgcctgtgatcccaacactttgggaggccaaggcatgaggattgcttgaggccaggagttcaagaccagcctgggaaacagcgacaccctgtctctac

SEQ ID NO: 51199 - DNA, 397 bp, Homo sapiens
  misc_feature 19, 25, 26, 32, 34, 35, 68, 173, 358, 361: n = A,T,C or G
agaatccggccattatttnccgggnncattgncnnttatgtaatccttagaaaatccttcttgaggancataaaaattttcccccatgtttactcctagtaagtacttttatactttttatgatttcattttaacatttaattatttgatttatttgcagtttgttttgttcnagagagtgaagtagtgaaataattttatatttcaagattatttcccatttgttccaataccttttattttgaattatccttcttaaccactttgaagtaccatttttgcatattcttgtagtatgggtgaaatatttcctctgcttttccatttatctgcagttcacacagaagtatcagactgntgngctataatttttaaatactagctaaacggttttcca

SEQ ID NO: 51200 - DNA, 400 bp, Homo sapiens
  misc_feature 7, 19, 59, 94, 341, 343, 399: n = A,T,C or G
aaagagncccaaagcagcncgatccaccagctgagaattcgtccgctcccgaggctgancagggcgggggctgagtaaatgccggcttaccatntctaccatcatccggtttagtcatccaacaagaagaaatatgaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagtctggtttttctcaatacgcctttaaaggntnttaaattgtttcatatctggcaagttgagatttttaagaacttcattttaatttgna

SEQ ID NO: 51201 - DNA, 380 bp, Homo sapiens
  misc_feature 75, 244: n = A,T,C or G
cggcaacagcatgggcctcacctcctctgtgatttctttctttgcaccaaagacatcagtctccaacatgtttcngttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgcattatttttgntagcaaagattaaatgtgcattggaagccatccctttttttacatttcatacaacagaaaccagaaaagcaatactgtttccattttaaggatatgattaatattattaatataataatgatgatgatgatgatga

SEQ ID NO: 51202 - DNA, 400 bp, Homo sapiens
  misc_feature 6, 9: n = A,T,C or G
gacacnccnggctcagggctgccagaatcagcggatgctggatgggcctgcagaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgagaggtgttgctgtttgaattgatgagaaatggaagatgagaactccctaagagttctcataataaatcatctcatcacaaatcaatacggtatacagagttaaagtggaatg

SEQ ID NO: 51203 - DNA, 344 bp, Homo sapiens
  misc_feature 8, 9, 89: n = A,T,C or G
attattannctagtcaaaaatgctaaaataatttgggagaaaatattttttaagtagtgttatagtttcatgtttatcttttattatgngggtgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattcta

SEQ ID NO: 51204 - DNA, 396 bp, Homo sapiens
  misc_feature 8, 10, 92, 266: n = A,T,C or G
atttctgncnagacaaaatttgtcagtgggttttcaagagctcaagggtaacaccctaacccccacgttgttcaagggtcaactgtattgcngtcaaaaacagaaatttaaaaaaaaaattccttcaaaaaaataaaattgtattacacacttgctaatccaattttgacacacaattttcttcaccatcaatataagatatgctatgccaggtttccttatttgtaataattcatgtattacttatagtttgctttagatatggnggttctttgtgtaaaatgtatttgtttatttttattatttatttatttcttatttttcatttttgagacagagtctcactctgtcgccaggatggagtgcagcggcatgatctcagctcactgcaatctc

SEQ ID NO: 51205 - DNA, 214 bp, Homo sapiens
taaatctagggtcagtatatatcgtagctagtctgttaaaaaggaaagtcatcctgtgggatcgtgacgtggaggatccctgggtgcctaagaggcagggacgctgacgcccagaaagcgggcattgcccaccgagacaaagaaaagcaaatgattgtccttcccgctgctcttggggattaaaaaacaatgaacgaattcttttattaaaaaa

SEQ ID NO: 51206 - DNA, 236 bp, Homo sapiens
tcccaatgggtgcagcccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgttaaaaaaaa

SEQ ID NO: 51207 - DNA, 274 bp, Homo sapiens
  misc_feature 7: n = A,T,C or G
agaaaanccggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactta

SEQ ID NO: 51208 - DNA, 184 bp, Homo sapiens
  misc_feature 46, 48: n = A,T,C or G
aaccccatctctactaaaaatacaaaaattaagccagtcgcggtgncncgtgcctgtaatcccagctactcaggaggctgaggcagaagaatcacttggacccaggaggcagaagttgcagtgagctaagatcatgcctctgcaccccagcctaggtgatagagtgagactccatcccaaaaaa

SEQ ID NO: 51209 - DNA, 100 bp, Homo sapiens
  misc_feature 2, 5, 95, 97: n = A,T,C or G
cnggnaacataacctagtttacagaaaaatcttgtgctagaatactttttaaaaggtattttgaatgccattaaaactgcttttttttttccagnangta

SEQ ID NO: 51210 - DNA, 263 bp, Homo sapiens
  misc_feature 90: n = A,T,C or G
atgataacctctgtaaggaagttcccaactataaacttataaccccagctgtggtctctgagagactgaagattcgaggctccctggccngggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatc

SEQ ID NO: 51211 - DNA, 395 bp, Homo sapiens
  misc_feature 90: n = A,T,C or G
gaagtagaccaattctgttaactggaaaatcacaggatatatccatcatatttttcaggacagatagtttttactgtggggcaaataggntaaaattacactatgttagttgcatttaggttttaaagcaaagaatctgtagagaaatctatgcaatatatagtttgtccagattagctttcatttggggaatggagttctgaaatatctaaagcagtttactcatcaattgaaaagtcctccaaaaagagaactattgggaaaccatggtgtggtggtggaaaagaaaagctccctcagttttttggagggaataacttaaaaaatacttaaatggctaagtttacttggtgcagttaagaattaaacttgcaattttaacattgctgatcatc

SEQ ID NO: 51212 - DNA, 271 bp, Homo sapiens
  misc_feature 14, 60: n = A,T,C or G
ccagggatgttgcngacatctaccagtttctccaaatgccttttttaaaactcatcacanaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtat

SEQ ID NO: 51213 - DNA, 400 bp, Homo sapiens
  misc_feature 4, 7, 81: n = A,T,C or G
acanatngaagaagaaaagaaagaaaaaacttaaatatttatttctatgctttgttgcctctgagaataatgacaatttangaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtaggttactaagggaacacacaaagaattacacaacgttttcctcaagaaaatggtcaaaacacaaccgaggagcgtatacagttga

SEQ ID NO: 51214 - DNA, 397 bp, Homo sapiens
  misc_feature 9, 21, 56, 89, 90, 353, 364, 392: n = A,T,C or G
gacaacccngggcttcaatgncaaagaatgtgtctgtcaaggatgttcgtcgtgtnaacgttgctggtgacagcaaaaatgacccaccnngggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggncgctttgctgntcgtgatatgagacagacaagttgcggngggtg

SEQ ID NO: 51215 - DNA, 153 bp, Homo sapiens
  misc_feature 2, 11, 14, 24, 40, 72, 119, 141: n = A,T,C or G
anaaaaaccgnatngggggttgtncggcgaatgccaaagnaaagcaaacttattataacccttggactgagntaagagacatttcttcaatttcccatagtgcctttccagggaccagngcagggacagggggagaagggnaggggttaaggt

SEQ ID NO: 51216 - DNA, 153 bp, Homo sapiens
  misc_feature 2, 8: n = A,T,C or G
gngcattnccccaaaatttggcattatgattagctttgtagaactgacctgtttatttggcaatgctgttaaaggatcatttcggtttcagacttcaaagttgattaataaatttaatcttaactttttattcactggaatcaaaaaaaaaaa

SEQ ID NO: 51217 - DNA, 395 bp, Homo sapiens
  misc_feature 10: n = A,T,C or G
gagcaaaacngtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgtccaccaaatacaattcaaatgctttttgttttatttttttaccaattccaatttcaaaatgtctcaatgggctataataaataaacttcaa

SEQ ID NO: 51218 - DNA, 191 bp, Homo sapiens
  misc_feature 8, 10, 94: n = A,T,C or G
agtgagancnaaatgaatgtattcctgtttttgaagagaagaataattttttttttctctagggagaggtacagtgtttatattttggagcctncctgaaggtgtaaaattgcaaatatttttatctatgagtaaatgttaagtaattgttttaaaatacttaataaaataattcttttcctgtggaagcg

SEQ ID NO: 51219 - DNA, 400 bp, Homo sapiens
  misc_feature 14, 16: n = A,T,C or G
tgcgggaagggagncngtagaagccaaggttgaagaattaaaatttgatcgttactctgtatttaggcctggagttctgttatgtgataggcaagaatctcgcccaggtgaatggctggttagaaagttctttggctccttaccaggctcttgggccagggggcattctgtgcctgtggtgaccgtggttagagcaatgctgaacaatgtggtgagaccaagagacaagcagatggaactgctggagaacaaggccatccatgacctggggaaagcgcatggtctctcaagccatgaccacactggagaaatggtttttattgtcaaccttaacacccatcaccaaatcggtaatttcagggctaaaaaaagtcagcatgttttaactttggtggtttac

SEQ ID NO: 51220 - DNA, 399 bp, Homo sapiens
  misc_feature 45, 47, 82, 107: n = A,T,C or G
gaagagcgcgaagacctaaggaggtaaaacagaacaggatggctntnagaaacccaccaacaaacacttcacgcagaggggnaagaagtcagtggccgacctgctgnggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggcctgtcaacaacagcaccatgaaaatcgaccactttcagctagataatgagaagcccatgcgagtggtggatgatgaagacttggtagaccaggcgtctcatcagcgagctgaggaaagagtacggaatgacctacaatgacttcttcat

SEQ ID NO: 51221 - DNA, 395 bp, Homo sapiens
  misc_feature 90, 92, 101, 192, 296, 306, 309, 333, 357, 358, 391: n = A,T,C or G
aaatgaacccttttaaaagcagaaacctagcagcccatctgctttttctcttttgtcggtgtatttggtacccctccaatgctggtcttngngtagaaacncagtagagaaagtctagctaagcagtgttgaaaagcctgcaagatttcagtttacatatcgacagcatatccactgatttctaaatgggcnggtcccatcatctgaagattctgtatagaattattaaaaaaaaaatccatctttctttattttcttcacatgcgacaatttcttaagcactttgacattttggnagtccacacnatngagagaataatatatttattttgngacattgcagatgccaaatactgnnaccttctcatgataacaatacttaggtcaagancact

SEQ ID NO: 51222 - DNA, 371 bp, Homo sapiens
  misc_feature 1, 10: n = A,T,C or G
naaaatgccntgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 51223 - DNA, 399 bp, Homo sapiens
  misc_feature 31, 33, 93, 98, 112, 115, 123, 128, 129, 211, 218: n = A,T,C or G
gagaatccggccttattttcggggagagtancngagaccatgagtatgcgtaacaggaggacacagcattattctagtgctgtactgttccgnacggnagccactacccacnggnaacttttnaaganntaaatttaaattagttaacattcaaaacgcagctccccaatcacactagcaacatttcaagtgcttgagagccatgcatgantagtggntaccctattgaataggtcagaagtagaatcttttcatcatcacagaaagttctattggacagtgctcttctagatcatcataagactacagagcacttttcaaagctcatgcatgttcatcatgttaagtgtcgtattttgagctggggttttgagactgcccttagagatagagaaacag

SEQ ID NO: 51224 - DNA, 100 bp, Homo sapiens
  misc_feature 34, 45, 58, 61, 73, 76, 84, 85, 87, 88, 89, 92, 95, 98, 99: n = A,T,C or G
gtatataaaagagtaaaatgatacagccagtaanaaaaaaaaaantttaaaaaaaganccnggggggcccccnggncccggggnncnnnaanccnggnna

SEQ ID NO: 51225 - DNA, 322 bp, Homo sapiens
ggacaagacgttatcattgaaattaaatggtggcagacatgtccaaggaatattgcggggatttgatccctttatgaaccttgtgatagatgaatgtgtggagatggccgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaataggcaaa

SEQ ID NO: 51226 - DNA, 308 bp, Homo sapiens
  misc_feature 8: n = A,T,C or G
atatgcancactacttgggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttaagaatatgaatatg

SEQ ID NO: 51227 - DNA, 292 bp, Homo sapiens
  misc_feature 8, 56: n = A,T,C or G
gattgatnccgacatgatccacatcgcggacaccaaggtcgccaggcgttatgggnatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggag

SEQ ID NO: 51228 - DNA, 192 bp, Homo sapiens
  misc_feature 2, 7, 47, 90: n = A,T,C or G
anagctncaatttattaatgcgaacagtacctaacaaacccacaggncctaaactaccaaacctgcattaaaaatttcagttggggcganctcggagcagaacccaacctccgagcagtacatgctaagacttcaccagtcaaagcgaactactatactcaattgatccaataacttgaccaacgaaaaaaa

SEQ ID NO: 51229 - DNA, 381 bp, Homo sapiens
  misc_feature 4, 11: n = A,T,C or G
cggnactaganccgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctcca

SEQ ID NO: 51230 - DNA, 211 bp, Homo sapiens
  misc_feature 2, 12: n = A,T,C or G
cngggatgaaanccaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcg

SEQ ID NO: 51231 - DNA, 396 bp, Homo sapiens
  misc_feature 1, 10, 67: n = A,T,C or G
natactgccnggaattgatggcaagaggatcccctgagcaagtcaagaagttactctcatcagtcgntcatggcacaacctgaggtactctgctggagtggggcaagctgaagaagagcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgctaaagtatgtgatgcttcatcatagtatgaagtgttgaaaattaataacgagcctagtttaggaaaaagctgcttaaaactgtggctctaagaga

SEQ ID NO: 51232 - DNA, 100 bp, Homo sapiens
  misc_feature 5, 6, 60, 82, 87, 95: n = A,T,C or G
ccggnngtggcccgaagaattattaaataataaaaaaaaaaaaatcaatcctcagtttgncctggccagacgagggtttctnggccncatttggnttcac

SEQ ID NO: 51233 - DNA, 282 bp, Homo sapiens
  misc_feature 2, 56: n = A,T,C or G
gnactcgccaccatacccgaagaaattctctcgtcaacgtggaactgtggacgatnattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgaccgggccagcgaggaagaagaaaacaaagccagtgaagaatacatacagaggttgttggcagaggaggaa

SEQ ID NO: 51234 - DNA, 399 bp, Homo sapiens
  misc_feature 6, 14, 40, 69, 89: n = A,T,C or G
aggaanccgatggngttgaggttggcataccgtatcaagngacagtaactaccatggctcccgaagttntgccaaaacctcggatgcgnggccttctggccaggcgtctgcgaaatcatatggctgtagcattcgtgctatccctgggggttgcagctttgtataagtttcgtgtggctgatcaaagaaagaaggcatacgcagatttctacagaaactatgatgtcatgaaagattttgaggagatgaggaaggctggtatctttcagagtgtaaagtaatcttggaatataaagaatttcttcaggttgaattacctagaagtttgcactgacttgtgttcctgaactatgacacatgaatatgtggctaagaaatagttcctcttgataaataaac

SEQ ID NO: 51235 - DNA, 123 bp, Homo sapiens
  misc_feature 2, 12, 50, 51, 63, 82, 83, 94, 95: n = A,T,C or G
tntttatactgnatgtaccaaagctttactactgtggaaagacaactgtnntaataaaagatntacattccaaaaaaggggnnaaaaaaaaaannggaaaaaaaaaaaaaaaaaaaaaaaaaa

SEQ ID NO: 51236 - DNA, 395 bp, Homo sapiens
  misc_feature 89: n = A,T,C or G
actcacccctacttcaaatgtcccattacattgatacagaccaggctcttcaatatggctgttggttcattagtgttgatcaaacagcncagctaaaatatgggaacaatttttaaagtggttttctggaagtagaaattaaactgagctcttgaagattcaacgagtgctaatgaacttcaagtcaatgaagaaattgtttgaaaaatatatacactttaaagattgcaatgaattatgtcaccttcttagagacacacaacttttgaattaaagaatcctactgatttgctcaagttttatatagacagtagcattagagtggcaacacagaagtataatgggcccacacagtggcactgtagatccttattttatcaagtatgttaatttag

SEQ ID NO: 51237 - DNA, 382 bp, Homo sapiens
aaaggtgcccttcataatgaagttaaagtgagtatactgtggagaggacttccaaatgtgggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaagggaggagtcaactaatgaagaaatgaataataaattttgacactgaaaaacattttattaataaagaatattgcatgagtataccagtttatatataaaaatgtttttaaacttgcaatcattacgctaaaacagatttg

SEQ ID NO: 51238 - DNA, 395 bp, Homo sapiens
  misc_feature 19, 47, 53, 56, 70, 159: n = A,T,C or G
gagcgatcctgaatcgcgntgcgacgaaggagtacgtgtgggatctncccgtnttnccgattagcctttntctctgccttgcttgcttgaccttcagcggaattcgaaatggctggcggtaaggctggaaaggactccggaaagccaagacaaaggcgntttcccgctcgcagagagccggcttgcagttcccagtggccgtattcatcgacacctaaaatctaggacgaccagtcatggacgtgtggccgcgactgccgctgtgtacagcgcagccatcctggagtacctcaccgcagaggtacttgaactgcaggaaatgcatcaaaagacttaaaggtaaagcgtattacccctcgtcacttgcaacttgctattcgtggagatgaagaatt

SEQ ID NO: 51239 - DNA, 400 bp, Homo sapiens
  misc_feature 2, 14, 93, 337: n = A,T,C or G
gngggaggaccccnactctgtctgtcatactccctgagtgtgtaagggccatctcttcagagcctaatgtgtcatcctacacagagcaggtgnggccttataaattaagttgaattaaattacccctatgaagccacataatcaataattcagctataataaacattgccgaataaattaacaaagggaggataatgactccttatgatgatggatagaaacactgaagaaaaccattttcagaggatttactgaatcttcctctccaaggagcttgtaatagaagggtaaacctctagtttcttgtccagcagaggaataggctcatgtcttttgntttattttatttttttggtgagcagtatggtgggttaatcatattcacattagattccatgtt

SEQ ID NO: 51240 - DNA, 153 bp, Homo sapiens
  misc_feature 10, 90: n = A,T,C or G
acacaggccnaggtggcatgcacctgtaatcccagctactcaggaggttgaggcacgagaatcaattcaacccaggaggcagaggttgcngtgagccaagatcacaccagtgcaggccagcctgggtgacagagcaagactccatccaaaaaa

SEQ ID NO: 51241 - DNA, 400 bp, Homo sapiens
  misc_feature 7, 13, 391: n = A,T,C or G
tcggggngggagnccaattcctctgacttgccaaagaaaaagaagggaaccacagtggatatgctagcattttagctgtgcaaagggaggtagtgggggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctgggggnatctgaaag

SEQ ID NO: 51242 - DNA, 277 bp, Homo sapiens
  misc_feature 10, 91: n = A,T,C or G
ggtgcttgcnaaagattacagatttgaacatgtagtgtacgtgctattgagttgtgaactggtgggcccgtatgtaacagctgaccaacgngaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttat

SEQ ID NO: 51243 - DNA, 398 bp, Homo sapiens
  misc_feature 16: n = A,T,C or G
aaatccgccttatttncggggaaatgaccaattagtaattggtaatgtccatttaatataagattcaaaaatccctacatttggaatacttgaactctattaataatgggagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgactgtaaatggaatgcttgacttagcaaaatt

SEQ ID NO: 51244 - DNA, 398 bp, Homo sapiens
  misc_feature 6, 19: n = A,T,C or G
agaatncggccattatttncgggatgcgaacgaatgaagttggattcctatccctcaccatgtaaaaaaaatcaactcaaaatggatcaacgacctaaatataaaagctgaaatcacacaactcttagaaaaaacataggagttaatcttcatgaccttggatttggcaatggattcttagataggacaccaaaaggaccagcaataaaagaaaaaaacagataaattggacttcgtcaaaatttaaaactttcgtgcacaaaggacattataaataaagtaaaatgacaacctatggaatgggaaaaatattttcaaactgtgtatctgataacaggttgaaatccagaatatacaaataactcttacaatgcaacaaaaacaacaacaatttttaa

SEQ ID NO: 51245 - DNA, 359 bp, Homo sapiens
  misc_feature 76, 77, 78: n = A,T,C or G
gccaagagaaaaaatttcctggggagggaggtttcccacaagccaaatctcctaagcctcaaatgctagcactttnnnggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggtattcacctttttttgattttgatttttgctgtgttatcaaaaacttgaatactgtgagaagaagtgaattttcagttgatgaatcagcatcttgttcccatggtgat

SEQ ID NO: 51246 - DNA, 372 bp, Homo sapiens
  misc_feature 12, 95: n = A,T,C or G
cggggataggancctctctccctactgctgctacacaagaccctgagactgacctgcaggacgaaaccatgaagagcctgatccttcttgccatnctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgaggggc

SEQ ID NO: 51247 - DNA, 395 bp, Homo sapiens
  misc_feature 2, 90, 91, 336: n = A,T,C or G
gnttctcacctaccttggagtgcataagacttacctagcaggcttgtttaaaaagttcagattcctagctttgtacccagggattgcctnnggtggtatgggctgtggtcctggagtcatcgcttttataaatagtggttcagagaccacagagagagactgcttcatcgaatgggaagtaccaaggagaaagtacaattcagtattgtctggaggcaagtggcactttgtacctgaggtttagaataggtggtctcttgccagtacaatccccaggcgttttctgtgtcagaagtagtaagaatgcctttaattcagaggattatctaagctctntaaagctggttttctccattgcatagtgccttctctgaaaaatgaatgtacaggatcct

SEQ ID NO: 51248 - DNA, 400 bp, Homo sapiens
  misc_feature 3, 20, 34, 38, 113: n = A,T,C or G
cgngaattcggccattattnccgggaggttacanaatncatatatgtgtggatttgtattaataatcaaattaataaaaacatttcattttctaccattgtatgaacgtaatnttattttttaataaccacactcatagatggttttgattgttccagttgagtgattgtgtatgtaccgcataggaatgttttgttcagttgtactttgtatttccaataatcagaaatcttacctttatgtataaaaacccattatgtaatgtaaaatgtataatattgtacataatattcagaatacaattattttggtaaattagcttgtatttttaatgtcccagttgcagtatttaattatttgaaccatactgaaagttggtaatagtcaataaagctaaaaa

SEQ ID NO: 51249 - DNA, 267 bp, Homo sapiens
  misc_feature 7, 16, 32: n = A,T,C or G
gaattcngccattatntccgggcttgcagccnaagatgacacttttaaaataaattctctcctaatgatgacttgagccctgccactcaatgggagaatcagcagaacctgtgggatcttatttggaattgacattctctattgtaattttgttcctgtttatttttaaattttctttttgtttcactggaaaggaaagatgatgctcagttttaaacgttaaaagtgtacaagttgctttattacaataaaactaaatgtgtgcac

SEQ ID NO: 51250 - DNA, 369 bp, Homo sapiens
  misc_feature 1, 8, 122: n = A,T,C or G
nctctttntccggctggaaccatggagggtgtagaagagaagaagaaggaggttcctgctgtgccagaaacccttaagaaaaagcgaaggaatttcgcagagctgaagatcaagcgcctganaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgcttcgtcaaa

SEQ ID NO: 51251 - DNA, 267 bp, Homo sapiens
  misc_feature 92: n = A,T,C or G
atataccacaattctgattggcagcaagttttattaatcagaataacacttggttatggaagtgactaatgctgaaaaaattgattatttgnattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattc

SEQ ID NO: 51252 - DNA, 400 bp, Homo sapiens
  misc_feature 5, 22: n = A,T,C or G
tccgngaattcggccattattnccggggaactcggcggtggccacttgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgc

SEQ ID NO: 51253 - DNA, 214 bp, Homo sapiens
  misc_feature 16, 90: n = A,T,C or G
gattgcaaccagtgcnagtgaccgacaaaattccagttatttatttccaaaatgtttggaaacagtataatttgacaaagaaaaatgatncttctctttttttgctgttccaccaaatacaattcaaatgctttttgttttatttttttaccaattccaatttcaaaatgtctcaatggtgctataataaataaacttcaacactctttatgac

SEQ ID NO: 51254 - DNA, 184 bp, Homo sapiens
  misc_feature 4, 20, 30, 114, 162: n = A,T,C or G
tcgngaattcggccttattnccggggaggnagcccaggtacgcaaagagaaccagtggtgtgaagagaagtgaaatgttgtgcctgacactgtaacactgtaaggattgttccnaatactatttgcactgctctgtttataattgttaatattagacaaacngtagacaaatgcagcagcaagt

SEQ ID NO: 51255 - DNA, 365 bp, Homo sapiens
  misc_feature 1, 9: n = A,T,C or G
ngtcgagtnggggtcagaaagctgtgaaacactcatttcctgcatcaggacttacttcggtcctggatgaagagtactgaagatacatgcctaaaatattcctaacaccaggatttgtgcatgtgtttccttccccaagaaagctataaacagcaaaaattctgctgtaagcttccctgtgtcctctctccctctcttccttccccctcccctaaaactaaaaggaatgttaaaagaccctttttctgtgaccagcggaccttatctatgctcccaattccaattccttgtgaacatactttgtaaagtcctgtaaaatcctgtctcttttgccatgctgctgcaaggtcataaagtagataaaa

SEQ ID NO: 51256 - DNA, 373 bp, Homo sapiens
  misc_feature 17, 21, 23, 90: n = A,T,C or G
aatttagaaggctgcantgangnacctgatgaagcttatgacctgcttgataaacttctagatctaaatccagcttcaagaataacagcnggaagaagctttgttgcatccattttttaaagatatgagcttgtgataatggatcttcatttaatgtttactgttatgaggtagaataaaaaagaatactttgtaatagccacaagttcttgttttgagaccttgtctcaaaaagaaaaaaagaaaagaatataattggattgttcgtaacacaaaggataaatgcttgagggaatggataccctgttttccaggatgtgattattacacactgcatgcctgtatcaaaacatcttatataccccatcaatat

SEQ ID NO: 51257 - DNA, 296 bp, Homo sapiens
  misc_feature 91, 92, 215, 288: n = A,T,C or G
gaaaaaaaggatcaccacaattcggaaggaaaggaaaagaaaaaaaaagagtggaatgccatgtttcagtagaaaacacctttaaactgtnncataatatggaatagctaataagaatatgaattcagcaaaacataggttagaaaataaacagtagagtgaatgaaaagacacctgagctaagaaaacaaattgaagatcaaaagaaatcacanggaacagaatggcaccccttaaaaacaagttattgccataggaaaaaagcttgaagtaatcacagtttatggnggtacctg

SEQ ID NO: 51258 - DNA, 374 bp, Homo sapiens
  misc_feature 361: n = A,T,C or G
atagtatccatattttattactgtttattacttccatgaattttaaaatctgagggtaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggntggtagatattga

SEQ ID NO: 51259 - DNA, 277 bp, Homo sapiens
acaggcttgaagattcctgatgtctcagcacccagcacggctgtcagcctcggcaggaggaagaccacggaaagtgagttttctgggcaggttggagagctgctgacagtgagaatgagcatggtgattacatctcaatatattaaactggctgatagagggaataaaaccacagacaaagtgtaagaggggtagattaacatgttttgcagaaatgtcttgaagtagaaaatgaaggaaaaatatcaaggggcagttgctgctattgaattcaata

SEQ ID NO: 51260 - DNA, 400 bp, Homo sapiens
  misc_feature 12: n = A,T,C or G
tcgggagctganccactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcggctaatttccccatagccgggggggacttccctg

SEQ ID NO: 51261 - DNA, 395 bp, Homo sapiens
  misc_feature 2, 22, 27, 35, 42, 56, 386: n = A,T,C or G
ancaacccccagatcaacctgnagctntacgcctnctacgtntacctgtccatgtnttactactttgaccgcgatgatgtggctttgaagaactttgccaaatactttcttcaccaatctcatgaggagagggaacatgctgagaaactgatgaagctgcagaaccaacgaggtgccgaatcttccttcaggatatcaagaaaccagactgtgatgactgggagagcgggctgaatgcaatggagtgtgcattacatttggaaaaaaatgtgaatcagtcactactggaactgcacaaactgccactgcaaaaatgacccccatttgtgtgacttcattgagacacattacctgaatgagcaggtgaaagccatcaaagaatgggnggaccacgt

SEQ ID NO: 51262 - DNA, 322 bp, Homo sapiens
  misc_feature 7, 86, 87, 88: n = A,T,C or G
ctccccnggtatttaatgcttcttatattctgaattcccttattttccacaaggtttgaaatatattatttaaattaacctgattnnntttatcatgaaaataaaatataacaatgcattagaagaaaactagagaagaattattttataatcctgagattgggagcatttttctaagactgatacaaagcccagaaaccataaataaaaatattgaaaaaaatgcatataataaaattttcatatattaaaaattcatggcatttaaacaccctcacttaagaaaagagaagtaaaacctgggaaatattacaaggaactt

SEQ ID NO: 51263 - DNA, 396 bp, Homo sapiens
  misc_feature 2, 10, 56, 60, 91: n = A,T,C or G
gngagcaccnggagatacagaaaccgacaggggccaggcacccggtggctccgaancggngaagtgggacaagatggtttacatctcgaanggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtaagaatcaatcatctgcgtggccctagtccccctccaatggctggtggatgaggaaggtaaatgtctgctctaagaagcagacaaccggcatgcgcat

SEQ ID NO: 51264 - DNA, 206 bp, Homo sapiens
  misc_feature 7, 18, 26, 44, 53, 67, 91, 92: n = A,T,C or G
gtaatancccgtaatcancttaaagngatgatttgatataatcntattgaaantaccttatcatgtnttagagcccgtctttatgtttaannctaatttcttaaaataaagccttcagtaaatgttcattaccaacttgataaatgctactcataagagctggtttggggctatagcatatgctttttttttttaattattacctg

SEQ ID NO: 51265 - DNA, 400 bp, Homo sapiens
  misc_feature 3, 6, 86: n = A,T,C or G
ccnttngggaattcggccattatttccggggtataaaccaagtaaaaaggatagaatgaaaaacccattctaatgtcaccactcanagataagtaccgtatttctgtgtatccttctataaactctttacttctgtttcctttattttttaactttaataatgctactaaaagacaatacctaaaagtaactgtactaacaaagtgctaacaatgtgaaaatatgtagtcccatagtcatgtccccatatttatactcccacagaagaaaaaattggaaaacaaagtctgatgtccttaatctattaacatatttaaatgatataatgggtcagttttccatgaaagtaaatcattatgggaagtaaaatgttttaaccatatttttcttaatacacaaa

SEQ ID NO: 51266 - DNA, 386 bp, Homo sapiens
  misc_feature 5: n = A,T,C or G
tgggnaaatgaccctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgc

SEQ ID NO: 51267 - DNA, 400 bp, Homo sapiens
  misc_feature 2, 15, 97, 111, 376: n = A,T,C or G
tnggggatcataccnctaacccaaactaattatcttcggcgtaaaaacgtgtcaactataaataaataaaataggaattaaaatccaacttatatgngggaaattcattgntaggacctaaactcaataacgaaagtaattctagtcatttataatacacgacagctaagacccaaactgggattaagataccccactatgcttagccataaacctaaataattaaatttaacaaaactatttgccagagaactactagccatagcttaaaactcaaaggacttggcggtactttatatccatctagaggagcctgtctataatcgataaaccccgtctacctcaccatctcttgctaattcagcctatataccgncatcttcagcaaaccctaaaaagg

SEQ ID NO: 51268 - DNA, 100 bp, Homo sapiens
  misc_feature 5, 22, 33, 38, 39, 43, 44, 45, 61, 66, 70, 74, 75, 78, 82,86, 89, 90, 97, 98, 99: n = A,T,C or G
ccagncagcccgaaaggttctntgaacaaaaanaaaannaaannnaaaaaaaaaaaagggnaaaanaggnatgnngcncgancaanaannaaaaaannna

SEQ ID NO: 51269 - DNA, 396 bp, Homo sapiens
  misc_feature 340, 367, 382, 384: n = A,T,C or G
aagagcgcccaagcggtcgaggctggaagaggatcctggcgccgcaggttctgtggacaatcacaatgggaatccaaggagggtctggctgttcggctgctgctcgtcctggctgtcttctgcattcaggtcatagcctgcagtgctacaactgtcctaacccaactgctgactgcaaaacagccgcaattgttcatctgattttgatgcgtgctcattaccaaagctgggtacaagtgtataacaagtgttggaagtttgagcattgcaatttcaacgacgtcacaacccgcttgagggaaaatgagctaacgtactactgctgcaagaaggacctgtnaactttaacgaacagcttgaaaatggnggacatccttataananaaacagtcttct

SEQ ID NO: 51270 - DNA, 191 bp, Homo sapiens
  misc_feature 83: n = A,T,C or G
aagcacggatggtgcatctgcaaggcgaatggtggtgtttctttcccacgatgttctgagcagccaaggcccgtttgttcagnttggatatcaagcttcacgagcccctgcacacataatgcatcagtggtgaaaagtactcactaaattatccgatccaaaagctattaaaaaacaacaacaacgccaaa

SEQ ID NO: 51271 - DNA, 396 bp, Homo sapiens
  misc_feature 1, 25, 53: n = A,T,C or G
ncttccccgggtgacattcagccgncggtcggggcgacggactctccattccntaaccatggccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtgccactgaggtgttgatgtggtttatgtcggagagattataggcaagcggggcatcattgctatgatgtttgaagaccaatctttaacatctgattatatttg

SEQ ID NO: 51272 - DNA, 108 bp, Homo sapiens
  misc_feature 80: n = A,T,C or G
cggaagctgtcgaccttgcacggtgatggcgctcctcgtgatcccttgtatcccctcaggctcgagccaggagcctaggnccactttgaaaagtagtaaaaaaaaaaa

SEQ ID NO: 51273 - DNA, 380 bp, Homo sapiens
catgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatcccctgtagcagcattactgaaatacataaggcttatatacaatgcttctttcctggatattctcttggctgggctg

SEQ ID NO: 51274 - DNA, 389 bp, Homo sapiens
  misc_feature 35, 37, 69, 367: n = A,T,C or G
attctaagatttggtttgggatcaataggaaagcntntgcagccaaccaagatgcaaatgttttgaaangatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgnatgtgccaaagctttactactg

SEQ ID NO: 51275 - DNA, 392 bp, Homo sapiens
  misc_feature 345: n = A,T,C or G
agatttatagttgggatgtctaggcctggagcattgccctttgctaagataagaaatataggtgttaaaattgatgttttctctttctttttagggagaacatgtaattggtttgggagggttgaatttaaggaaaaacatctgaaaccctcttacacagactgatagtgctgtgataggaagaaaatacccagagagaatgtacagtaagaagaaggaatctaaagacaaaccttggcgcatctctctataaccagcagtcagaaaggagggaaatcaaaagaaagtgtcagagaatgagtaggttaatacatagcaggtaaatgaggatggtgctttgccaanggcaaaagagaaaaacattcagaaagtaactagttattctatagaga

SEQ ID NO: 51276 - DNA, 466 bp, Homo sapiens
  misc_feature 419: n = A,T,C or G
ccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgctatgccaagtcctggaaaaggagcttcagtattgtggggctcataaaacatgaatcaagcaatccagcctcatgggaagtcctggcacaagttttttgtaaagcccttgcacagctggagaaatggcatcattataagctatgagttgaaatgtctgtcaaatggnctacatctacacgtggcttggaggctttatggggccctgtccaggta

SEQ ID NO: 51277 - DNA, 550 bp, Homo sapiens
  misc_feature 23, 513: n = A,T,C or G
accagacttcgctcgtactcgtncgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgcctgctttcccatctgtctatctatcttggctggcagggaaggaaagaacttgcatgttggtgaaggaagaagtggggtggaagaagtggggtgggccgacagtgaaatctagagtaaaccaagctggtccaaggtgtcctgcaggctgtaatgcagttaatcaanaggccattttttttttggtcaaaaggattttaatttt

SEQ ID NO: 51278 - DNA, 336 bp, Homo sapiens
  misc_feature 1: n = A,T,C or G
natggaacccatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 51279 - DNA, 396 bp, Homo sapiens
  misc_feature 335: n = A,T,C or G
attcttcccctctctacaaccctctctcctcagcgcttcttctttcatggtttgatcctgactgctgtcatggcgtgccctctggagaaggccctggatgtgatggtgtccaccttccacaagtactcgggcaaagggggtgacaagttcaagctcaacaagtcagaactaaaggagctgctgacccgggagctgcccagcttcttggggaaaaggacagatgaagctgcttccagaagctgatgagcaacttggacagcaacagggacaacgaggtggacttcaagagtactgtgtcttcctgtcctgcatcgcatgatgtgtaacgaattctntgaaggcttccagataagcagccaggaagaaatgaaaactcctctgatgtggttggggggc

SEQ ID NO: 51280 - DNA, 214 bp, Homo sapiens
  misc_feature 92, 211, 213: n = A,T,C or G
ggggacctccagagggaaggggacagatgtttctcattgcataatgtcacagttgcctcaaatgagcaccatttgtaataatgatgtcaatntcatgaaaagcctgagtgtattgcatctcttgatttaatcatgtgaaacttttcctagatgcaaatgctgactaataaagacaaagccaccctgaaaaaaaaaaaaaaaaaaaaaaaangna

SEQ ID NO: 51281 - DNA, 215 bp, Homo sapiens
gcaacagctctcacctacgcgagtcttactttgagtttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggaaaaaaaaaa

SEQ ID NO: 51282 - DNA, 330 bp, Homo sapiens
caagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatgttgtatgtcccttcctctgtacaaattgtaaaatacttaaaataactatgaagaattcatataggaagtgtgatactattgtaaatgtgtatttgagaatatgcaaaaataaaaataatattttact

SEQ ID NO: 51283 - DNA, 380 bp, Homo sapiens
  misc_feature 11, 329, 364: n = A,T,C or G
atgaaaacagnaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccaggagtaaagtttctaaaataacattcctctcacttgtaccccactaaaagtattagactacacattacattgaagttaaacacaaaattatcagtgttttagaaacatgagtccggactgtgtaagtnaaagtacaaacattatttccaccataaagtatgtnttgaaatcaagttgtc

SEQ ID NO: 51284 - DNA, 500 bp, Homo sapiens
  misc_feature 31: n = A,T,C or G
aaggcattgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggggattaaaagaccttgaaatccatgacgca

SEQ ID NO: 51285 - DNA, 346 bp, Homo sapiens
  misc_feature 5, 6, 18, 31: n = A,T,C or G
gtgannaggaaatccggnggtgataaggtanacagactgagaaagaagacacaaggagagaaaagtaaagagaggaaagatgagcattaatgagggtgcttacaagcggcagaggcagtgaatacaaaaacttagtggaaagaaagcaacgacgaaacaagaataggatgagttctcagttacctactttattcttcaaatagcccttattcagcacatctttcttgtttgttgtagaatgaagaagcaagacgaaaacacacaggagggaaaatcctgggattctttttctagggatgtaatacatatatttaccaataaaaaaaaaaaaaaaaaaaaaaaaaaa

SEQ ID NO: 51286 - DNA, 287 bp, Homo sapiens
ctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttgactaaaaaaaaaaaaaaaaaaaa

SEQ ID NO: 51287 - DNA, 310 bp, Homo sapiens
  misc_feature 56: n = A,T,C or G
aactggagtactatgtagcagaagtacagctgaggtatgccaagggacttcttcanggaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgg

SEQ ID NO: 51288 - DNA, 430 bp, Homo sapiens
  misc_feature 29, 30, 31, 203, 231, 342, 367, 408, 410: n = A,T,C or G
tggatctgggggttgtgttgacattttannnaatggatggagttaaggaaagttccggaaaaagaaagtattggaaagaaaaaaaaataaagagggcagtttgaaaaagaaggtattagaaagaaaaaaaaataaagagggtagtttgggcagttaacattcaatgacattttccattttgtctgatttaagaattatgaagngtccatgattatatgcataataaatagngcccttgtacatctatttgcttagtaagaaaaggatgcaatgctcagatcttcagagttaacaaatgcttttgcaagcaggaagagatacactctttataccacttcaggngatgttgaagactgtcatgtagagngctggcaatatgcttatataaaagctgctaaaatacatgcncntaattagactattatacggg

SEQ ID NO: 51289 - DNA, 242 bp, Homo sapiens
  misc_feature 12, 14, 219: n = A,T,C or G
ggccggggagangnacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcgtaaattgacaatgtcaataaattgaaatatggttcactgttnctcaaaaaaaaaaaaaaaaaaaa

SEQ ID NO: 51290 - DNA, 570 bp, Homo sapiens
  misc_feature 34: n = A,T,C or G
acaactggagtaaatattacacaaatacttattnattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcatttttgaagctaattattttaattagggtaactatgtacaatattttaagc

SEQ ID NO: 51291 - DNA, 580 bp, Homo sapiens
aagcagatactggcctattcactgaggtgctaagcaggggtgggcaccctgcctggctctgtagtggtcatttctgacaggcctgtgttgtggagacagacacactaggttttcagagtctgatgcagttacattcgaattaggcaaatctcatactgattctgattccatgttccccgcaacaggcacccggtaaactggctttctggagagtctgcctttgagcagagaatgtgattttcccactgtccttctctgacctctcggcagttatacaattcttattgtaaaataaagctctattctggttttgtgcatcagtctcctgtgggtttaattcacatgcaagagcgtcctcgagcctgaatgagcctggaatggaatacagtttcccagcccatgaatcatgacctgaatcatgtcaaattcaccaagttatgctcccttttaaggtcacttggcagacaggcaggtaggaactttcctggtgaaccctccctgtatgaccatgcagctttccactgggagcttttacaggttgctgctatttttataaaaatgatagactgtaatgttgccg

SEQ ID NO: 51292 - DNA, 600 bp, Homo sapiens
  misc_feature 17, 30, 33, 47, 464: n = A,T,C or G
attatggccgggaatgnctgctcaacaggnagnaaccccaaggtttntgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggnggcacacacctgtagtcccagctactcgggaggctgaggcagatgaatcacttgaacctgggaggcagaggttgcaggtgagcccgagattgcgccactgcactccagcctgggcgacagagcaagactcccttct

SEQ ID NO: 51293 - DNA, 208 bp, Homo sapiens
atgtcttacttggcaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataaaaaaaaaaaaaaaaaaaa

SEQ ID NO: 51294 - DNA, 143 bp, Homo sapiens
gttttcatcttctttcctatctggaccttagagcttgttattcgtctaaaattcaactgttagattgttttgtaatattcaagcttttgcataattgatagtatgagacgtaagcctccccctaccaaaaaaaaaaaaaaaaa

SEQ ID NO: 51295 - DNA, 384 bp, Homo sapiens
  misc_feature 18: n = A,T,C or G
tcaaagcagtggacaagnaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagcaaaaaaaaaaaaaaaaaaaaaa

SEQ ID NO: 51296 - DNA, 947 bp, Homo sapiens
  misc_feature 4, 8, 20, 283, 487, 544, 595, 672, 679, 704, 705, 706, 708,709, 711, 712, 713, 714, 715, 716, 717, 718, 719, 720, 721,722, 723, 724, 725, 726, 730, 731, 735, 744, 746, 751, 752,753, 754, 755, 763, 764, 765, 766, 768, 769, 770, 772: n = A,T,C or G
  misc_feature 773, 777, 778, 779, 786, 789, 791, 794, 795, 800, 802, 808,810, 811, 812, 817, 819, 820, 822, 823, 824, 825, 826, 827,828, 829, 830, 831, 832, 833, 834, 835, 836, 837, 838, 840,841, 842, 843, 844, 845, 846, 847, 848, 849, 850, 851: n = A,T,C or G
  misc_feature 852, 853, 854, 856, 857, 858, 859, 860, 861, 862, 863, 864,865, 866, 867, 868, 869, 871, 872, 874, 875, 876, 877, 878,879, 881, 882, 883, 885, 886, 887, 888, 891, 892, 893, 894,895, 896, 897, 901, 905, 906, 907, 909, 910, 911, 912: n = A,T,C or G
  misc_feature 913, 914, 915, 918, 920, 921, 922, 923, 924, 926, 929, 932,934, 935, 939, 940, 941, 942, 943, 944, 945: n = A,T,C or G
ttcncccngggaattcggcnttatggccggggacttcggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgngaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgnactctcagaatgtttgtcatatgcttcttgcaatgcatattttttaatctcaaacgntcaataaaaccatttttcagatataaagagaattacttcaaattgagtaanttcagaaaaactcaagatttaagttaaaaaagggggtttggacttggggaacagggactttatacctcttttactgnaacaagnactcattaaaggaaattggatgaannnannannnnnnnnnnnnnnnnaaanntggnggggccccngnccccnnnnnttttttannnngnnnanntttnnncgggggnccnanttnnggccncnttgggnannnccccngnngnnnnnnnnnnnnnnnnngnnnnnnnnnnnnnnngnnnnnnnnnnnnnncnncnnnnnngnnncnnnnggnnnnnnnccgnggcnnngnnnnnnncgncnnnnncnccnggncnngggnnnnnnngg

SEQ ID NO: 51297 - DNA, 994 bp, Homo sapiens
  misc_feature 14, 625, 629, 686, 688, 715, 734, 735, 759, 800, 802, 807,811, 812, 818, 819, 824, 826, 830, 833, 836, 842, 843, 845,849, 854, 862, 863, 873, 877, 878, 903, 910, 913, 928, 932,937, 940, 947, 950, 959, 962, 967, 978, 980, 988: n = A,T,C or G
ttttgacccggggnaattcggccttatggccgggggtggcccggatgttcggtgcagctgccagatccgctgatctagcgcttctcgaaaaaaaccttcaggcggcccatggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcactttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtacctcatgaagccgtctacccactatataccattggatttatctattacgcatttctgcttgggattaaatgatgctgctccgacctcttctgggggangaanattgcatgtggggtaagggaaaatctggaatggtttaaaaaaggattttatgctggncntttacttttttccccaatttaaaccgnggctttcaggccagttggnngggaggcccctttttatattaccncccttccccatacattaaattaaggggtaaccttttggggnanccccngggnnggggannatggncngccnttntgnaaaaannanaacntgctntagatctnntggggccagnaaannaaaaaaactttattgggtttttttncgccccnggnaactttatggccctnaggnaaaanccnccctttnccnagggggatnaanacttngaacaagaatngncccttttnggtttg

SEQ ID NO: 51298 - DNA, 389 bp, Homo sapiens
aagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaa

SEQ ID NO: 51299 - DNA, 640 bp, Homo sapiens
  misc_feature 403, 458, 460, 463, 502, 513: n = A,T,C or G
aacctcttagtacaataaaattattgtgtttcccgttttaattcttcgctatggtcagcgtattttactttttacagaaatcaggaactttagtttctttgaaaaaattttatacagggtaaggcacaatgttaacagtttaactctgtgtgtttgtaacaagttctagaatggctttctgtattttctaagtacatgctacagccaatgcaatcaccataatatacattgatcagcttgcattgaatatttccagacagggacactaagctatcattttccttagcatcaaaatttgccacttttaccagaaggtcatctaacagatttttaaaagactttgtttcagatctcggtagtcctgtgttccttttaataattactttagtctcattgtagctgngtgtttgaaagtgtaggtcaatgaggatgattgcattcagaatttcatgatctgngnagnggaacaaattggaaagcaaagccctgtatcaatcactgngaagggagggntaattggtaccgcttctcaagcctctggacagataaaccaggaatgaaatacttattgctctgaaatgggaaagctaaaggatgaaacaatggaacagaagccggcttcagagatacccaattaagc

SEQ ID NO: 51300 - DNA, 408 bp, Homo sapiens
agcaaaacagtctttgaatatcgaacacgcaaggctgtgagactacctattgtagatattgcaccctatgacattggtggtcctgatcaagaatttggtgtggacgttggccctgcttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatataattcaaatgctttttgttttatttttttaccaattccaatttcaaaatgtctcaatggtggtataataaataaacttcaacactctttatggt

SEQ ID NO: 51301 - DNA, 532 bp, Homo sapiens
  misc_feature 22, 23, 476: n = A,T,C or G
taatactggtgtcgatattgtnntgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcatgactggcttctgcttgtcatccacacaacaccaggacttaagacaaatgggactgatgtcatcttgagctcttcatttattttgactgtgatttatttggagtggaggcattgnttttaagaaaaacatgtcatgtaaggttgtctaaaaataaaatgcatttaaactca

SEQ ID NO: 51302 - DNA, 600 bp, Homo sapiens
  misc_feature 5, 570: n = A,T,C or G
tcccngggaattcggccttatggccgggtggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatcccgtgttggctggattttgaaaatccaggaattatgttataacgtgcctgtattaaaaaggatgtggtattgaggatccattttcataaagnatgattttgcccaaacctgtaccatttccg

SEQ ID NO: 51303 - DNA, 136 bp, Homo sapiens
gcattcctgaagctgacagcattcgggccgagatgtctcgctccgtggccttagctgtgctcgcgctactctctctttctggcctggaggctatccagcgtactccaaagattcaggtttactcacgtcatccagc

SEQ ID NO: 51304 - DNA, 190 bp, Homo sapiens
gctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaaaaaaaaaaaaaaaaaaaaaaa

SEQ ID NO: 51305 - DNA, 329 bp, Homo sapiens
aaaataagtgattcatttataggactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaatg

SEQ ID NO: 51306 - DNA, 460 bp, Homo sapiens
  misc_feature 9: n = A,T,C or G
atattatcngcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgggagcagttggttacagcgct

SEQ ID NO: 51307 - DNA, 354 bp, Homo sapiens
  misc_feature 29, 32: n = A,T,C or G
ataccgtgaatctaagaagatcgatcgcnacntgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgcccgtgaagagcgcctccaggccaagaaggaggagatcatcaagactttatccaaggaggaagagaccaagaaataaaacctcccacttttgtctgtacatactggcctctgtgattacatagatcagccattaaaataaaacaagccctcaaaaaaaaaaa

SEQ ID NO: 51308 - DNA, 600 bp, Homo sapiens
  misc_feature 498: n = A,T,C or G
tatcaatgcagtagctgcttttcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggngccttttttataaaagctgaagtcctgagcgaggagcccattttgaagtgggataaaagatgcacatgttgcaagggggaagagtgttttccttgagcaaat

SEQ ID NO: 51309 - DNA, 540 bp, Homo sapiens
  misc_feature 13: n = A,T,C or G
tatagcataaagntaggaaaaagaaagacaaataaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatc

SEQ ID NO: 51310 - DNA, 430 bp, Homo sapiens
  misc_feature 28: n = A,T,C or G
cgggcttgttcgctggtggcgtctttanccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggctttcacacttcacttcatcccttctacccatcacaacatacaaagcaacctacacctggatttttccaaacaacttttatttcctcagagtcttccttaatcctatggaacaagaagctgccactgaataagggcccagtataggggcttgcttttctactccctccccccaatataaaaatatagacttttaaaaaaaaaa

SEQ ID NO: 51311 - DNA, 110 bp, Homo sapiens
  misc_feature 20, 31, 35, 72, 104: n = A,T,C or G
agtccatgtaattttaacanatttaacggcntttnccgaactgatggaataaattttggaaaattgtcctgncctctgcttacatgttaccataataccttcgnctcctg

SEQ ID NO: 51312 - DNA, 260 bp, Homo sapiens
  misc_feature 7: n = A,T,C or G
tgccgcnatgtctgtgtaggcatgctcagcacgggggagaacagaaatccagcccaggtgttgctttagcaagctctggtctgtagctgtgtcagcctgaaggaagagtcaagttttcctgattttataggaggctaggatggccccgttgtaagtcttactttttttctgtaagtttctctttgaaattgctgtaaggtttccttgaaccagttatttccttgtctacaatactgaaaaaaaaaaaaaaaaaaaaaaaa

SEQ ID NO: 51313 - DNA, 197 bp, Homo sapiens
aacatccttcgagaaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaaaaaaa

SEQ ID NO: 51314 - DNA, 390 bp, Homo sapiens
  misc_feature 31, 98, 138, 215, 234, 254, 276, 373, 386: n = A,T,C or G
aattgcattggcatttttaataagaacaaanttagttcgtctaaggggactggctggccacatatttgttccttgcccatatgctttctacttcttgntcttattatgaaattatgaatttgaagcctctgaaatggngatcaagttttcaacatctttcaaaaacaaaattactatttcctccatattgcccttttttagataactttaaaggnaggattttaaaatatttgnaactggctaaattttaaagncgggacaaataattacttaggntcagaaatatacacacacttactctttagccaggtttctttcaaggggttacctggcccatcagatatctagccattttcctttgcaaattacatancctcttaaagagnggat

SEQ ID NO: 51315 - DNA, 238 bp, Homo sapiens
  misc_feature 183: n = A,T,C or G
cgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatacntaggcctaaaagcagccaccaattaagaaagcgttcaagctcaacacccactacc

SEQ ID NO: 51316 - DNA, 261 bp, Homo sapiens
gaaattctggagttgaaaaatgtgattgatatattgaagaatgtatcagccttaactgcggaatttatcaagcaaaagaattagtaagcttgaagacaagctatgcacagaggagacaaaaggaaacaataagaaagaatgaagcacacctgcaagatatagatttgccctcaaaaggacaaatttaagaattattggctcttgactacctcaagacatttaaaaatgaaactcccaatgatcaaaaaaaaaaaaaaaaaa

SEQ ID NO: 51317 - DNA, 253 bp, Homo sapiens
  misc_feature 241: n = A,T,C or G
gaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgctaanaaaaaaaaaaaa

SEQ ID NO: 51318 - DNA, 230 bp, Homo sapiens
  misc_feature 208: n = A,T,C or G
agctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagccccttggggacgacagctccaggagtaggaagaagggngggcttccaagttacaataaat

SEQ ID NO: 51319 - DNA, 618 bp, Homo sapiens
  misc_feature 524, 613: n = A,T,C or G
agtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacaaatggagatgcaggagctgcgggagccgaattcggtcctgaaaaacactaatttgctgctttctgaccaaatgtttttccatctgtgtacagctccagctgtttgaaagagagggaacaacacgggntttagaaagaatccccattccagcagtagatttaactgatctctgagggtcagtatcattttttcaaataaaggaattatttttggganaaaaa

SEQ ID NO: 51320 - DNA, 510 bp, Homo sapiens
  misc_feature 69, 478, 503: n = A,T,C or G
tattttgctgatcggctgtatgactccatgaagggcaaggggacgcgagataaggtcctgatcagaatnatggtctcccgcagtgaagtggacatgttgaaaattaggtccgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgaccgttagcattacccccaacctcattttagttgcctaagcattgcctggccttcctgtctagtctctcctgtaagccaaagaaatgaacattccaaggagttggaaggtgaaagtctatgatgtgaaacactttgcctcctgtgtacctgngtcataaacagatgaaataaactgnattttgt

SEQ ID NO: 51321 - DNA, 149 bp, Homo sapiens
  misc_feature 27, 34, 74, 86, 95: n = A,T,C or G
aaaccgcagataagtttttttctcttngaaaganggagattaatacaactacttaaaaaatataggcaataggntactaagatatngcttagcgntaagtttttaacggaattttaatagcttaagattttaagagaaaatatgaagac

SEQ ID NO: 51322 - DNA, 159 bp, Homo sapiens
  misc_feature 136: n = A,T,C or G
attataactctgtataatagagataagtccattttttaaaaatgttttccccaaaccataaaaccctatacaagttgttctagtaacaatacatgagaaagatgtctatgtagctgaaaataaaatgacgtcacangacaaaaaaaaaaaaaaaaaaaa

SEQ ID NO: 51323 - DNA, 550 bp, Homo sapiens
  misc_feature 30, 325, 420, 435, 450: n = A,T,C or G
aggccttgaggcagccagcgcaggggcttntgctgagggggcaggcggagcttgaggaaaccgcagataagtttttttctctttgaaagatagagattaatacaactacttaaaaaatatggtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactncagagccccgaattaataccaatagaagggcaatgcttttagattaaaatgaaggtgacttaaacagcttaaagtttagtttaaaagttgtaggngattaaaataatttngaaggcgatcctttnaaaaaaggagattaaacccgaaggggattaaaagaccttgaaatccatgacgcagggaggaattgcgtcatttaaagcctagttaacgcatttactaaac

SEQ ID NO: 51324 - DNA, 500 bp, Homo sapiens
  misc_feature 30, 149, 442, 490: n = A,T,C or G
atattgcttagcgttaagtttttagcgtanttttaatagcttaagattttaagagaaaatatgaagacttagaagagtagcatgaggaaggaagagataaaaggtttctaaaacatgacggaggttgagatgaagcttcttcatggagngaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcattttaaagcctagttaacgcatttactaaacgcagacgaaaatggaaagattaattggggagtggnaaggatgaaacaatttggaggagatagaaagttttgaaggggaaaacntggaagaaca

SEQ ID NO: 51325 - DNA, 340 bp, Homo sapiens
  misc_feature 209, 272: n = A,T,C or G
agtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcacttgccgnggcgccttgagtctccgggccgccttgccatggctgcccgtggtgtcatcgctccagttggcnagaagtttgcgctacgctgagtacttgcagcccttcggccaaagggccagacgccgacgtcgaccagc

SEQ ID NO: 51326 - DNA, 538 bp, Homo sapiens
aattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctattttcagttcattaaaaactgcaaaaccaatctgtatcatgtaccaaactgacttaaaataaatctacatgtttattaaaaaaaaaaa

SEQ ID NO: 51327 - DNA, 394 bp, Homo sapiens
gagcgcggcggctggaagctgctaagtagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgacccttcaaagctaaaatataaaactatttggggaagtatgaaaaaaaaa

SEQ ID NO: 51328 - DNA, 297 bp, Homo sapiens
tctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacacatgtaaaatcagaaaacagggaaattttcattaaaaatattggtttggaaaaaaaaaaaaaaaaaaaaaa

SEQ ID NO: 51329 - DNA, 128 bp, Homo sapiens
  misc_feature 27: n = A,T,C or G
aagcctgcgtgaggattaaaacactgnactgacaattaacagcccaatatctacaatcaaccaacaagtcactattaccctcactgtcaacccaacacaggcgtgctcaaaaaaaaaaaaaaaaaaaa

SEQ ID NO: 51330 - DNA, 560 bp, Homo sapiens
  misc_feature 497: n = A,T,C or G
agcgagccttcctcactagcctgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcatctaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaaatttatgttctgtctggncgctgcagattctcagcagcacttttactgtatatagaaattgaaataaagacctcagctatt

SEQ ID NO: 51331 - DNA, 490 bp, Homo sapiens
  misc_feature 25: n = A,T,C or G
agtctctttgcggcgctacactagnagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacta

SEQ ID NO: 51332 - DNA, 410 bp, Homo sapiens
aattgtattctctattttagaatcctagtaaagcttgcaccctctaagaaaaagtagagatgtccagtctcatgaaaaattctgcatataattttagattaaaatccttggcctgagaaagatactggaaccagagagacagccaagaaatagatagaagaatattggaagttggcatataataaaagtggtataaacatatcaatgaagaaatggctgaagaatgatacagaaaagaaactgatttctaattcatactgtattttaaaaaatatttgctaggtggattaaagatctaaatgtagaaaagtaaacttggaaaattcaaaagaaaatataagaatttttatgctatagagaaggatatttttaaaaacaaattgactaaaacataatatgcattgaaatac

SEQ ID NO: 51333 - DNA, 580 bp, Homo sapiens
  misc_feature 5, 446, 450, 561: n = A,T,C or G
aatcnaaaccaggcattcagagtaaaactgctgaaaattaaagacagagaaaaatctaaaaagcaggtggaagggaaagacagattactttgaaaagtacaatgacaaaatatataactgacttctcaataaaacattgcaagtcagaagtcaatggtgtgatatctttaaagtgctaaaagaaattgccagctcggaattctatacccagtgaaaatgcccttagaagaaagaacaaaaataagatttttttaaaaagttcagacaaacagtgaaataatttgtcacccagaaagcctggctgggtgtgggtggttcatgcctgtaatctcagaactttaggccgtggcaggtggatcacctgaggtcaggagttggagaccagcctggccaacatggagaaaccatgtctctactaaaaatacaaaaattaggtggtcattggngggngaacgcctgtaatcccagctactcagtaggctaaggcaggagaaattcttgaacccgggaggctgaggttgcagtgagccaagatcacaccattgcactccagcctgggcnacagagcgagtctcaatct

SEQ ID NO: 51334 - DNA, 290 bp, Homo sapiens
  misc_feature 268: n = A,T,C or G
aaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattagcattcaacatatgtaaaatcagaaaacagggaaattttcattaaaaatattggnttgaaataaaaaaaaaaaaaaa

SEQ ID NO: 51335 - DNA, 630 bp, Homo sapiens
  misc_feature 50, 514, 525, 535, 577: n = A,T,C or G
ttatggccgggaataattacaaagcttggaagtattcaaatagaaaatcnaaggtgtttcaatacagtagaatcccaggactgcattttaaaatcgcctctcagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgccctagtagttctctccagggcaaatgaagctcacagttttgcaaggtggaaacctcttattcacatttgctttgattccccgatggagtagactgcctttgttccatacaggcaaagtaaggatatttttaatatcatcctacttcttattagcatttcatttgnctatgtactgnatttcatttngggatggcctcctgaaacatccaaatagagaacataagaacnctttatgtacaatctggaaaaaaattacctgagaaatcaattaaaagaatttt

SEQ ID NO: 51336 - DNA, 367 bp, Homo sapiens
aaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttggaaaaactccaaaaaaaaaaaaa

SEQ ID NO: 51337 - DNA, 550 bp, Homo sapiens
  misc_feature 31: n = A,T,C or G
atctacaggattgtcctgttactaatgtgcnagattggaatgaatgtttagataccatcgcctatgagccccaaattggttactgtataagtgcatcaactttacagcagttaagtttcccagttagagcatacaaacgactagatggttcaactgaatgctgtaacaatcacagccgcacagatgtgtgcttttcctacagaaataattttaataagcgtttgcatacatgtcttcctgcccggaaagcagttgaagcaactcaagtttgcagaaccaataaagactgtaaaaaaaagctcaagttcaagtttctgtataataccttctttggaaactcacactcgcttaataaaagtaaaacacccacctcagattgatatgttataccgtaggacatcctctgcatcttcactacacaggagttgctgctggaccacatgacaccagtcccattcttgaagcagaatgttcaaagagtgtgtacaaaatgcagaagccacccatttccaagaaaaacggctatgcttcaaccagcctaagtctactg

SEQ ID NO: 51338 - DNA, 478 bp, Homo sapiens
  misc_feature 19, 397: n = A,T,C or G
ttgcctgttctgcttcgantattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacattcc

SEQ ID NO: 51339 - DNA, 600 bp, Homo sapiens
  misc_feature 31, 468, 489, 520, 589: n = A,T,C or G
gaactctaattccactaggggctctcatctnacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggntggacagtagattagcaaagntccaagtgcaaagttacagtgtgtagagtgnggggggaaaattagtcttatttttccctacatgggatacaacactgggaattcaatcttcaactgaagncctgcaggtct

SEQ ID NO: 51340 - DNA, 600 bp, Homo sapiens
  misc_feature 6, 461, 486, 517, 537: n = A,T,C or G
aaaagnacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagnttcagaaccttttacgttctcgggnagaggcttctgtcggacaggcagaagagggnattcctcactttttttttgncttcaaattccagtaaggcatagcacttttaagaaaatagaaattttctatcatctatgcaaa

SEQ ID NO: 51341 - DNA, 387 bp, Homo sapiens
aagtccctgtactattatatccgcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtcctaaaaaaaaaaaaa

SEQ ID NO: 51342 - DNA, 350 bp, Homo sapiens
tatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatgcacaggtatctaag

SEQ ID NO: 51343 - DNA, 670 bp, Homo sapiens
  misc_feature 562, 586, 606, 628: n = A,T,C or G
gagaatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtgggggtgtgatggaacaggccagttggcctaagaattagtacttgctctaataatgggtttcatctattttcatgagttgcagcatctgcatatacaaggcctggatcacttttaggatcaatattttgacacgggagaaggcagctcagaaaggataagggaagatagctcaaagccaaagcagaccctccgggngaactttatactgctcacttccgngtttcccaagtaaatggggnaaactgtccaaccttggcatgngttgggacttactgcttgaggcaaagcattcatcctacatca

SEQ ID NO: 51344 - DNA, 118 bp, Homo sapiens
gtgcggaccaggggaatccgactgtttaattaaaacaaagcatcgcgaaggcccgcggcgggtgttgacgcgatgtgatttctgcccagtgctctgaatgtcaaaaaaaaaaaaaaaa

SEQ ID NO: 51345 - DNA, 225 bp, Homo sapiens
gtaaaagtactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaa

SEQ ID NO: 51346 - DNA, 440 bp, Homo sapiens
  misc_feature 420: n = A,T,C or G
aggccttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgctaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngattaaaataatttgaaggc

SEQ ID NO: 51347 - DNA, 188 bp, Homo sapiens
tgaaatttggatacttggaaaagtctacattaatggatgaatggtaggaccgaggaagcctaattatcaaccacagggagctagggcagtcactaattctggtttctcctctggaaaagtagctgtgtgaattgtgtgttgcctagagctgtcaacttacttcgaaaaaaaaaaaaaaaaaaaaaaaa

SEQ ID NO: 51348 - DNA, 403 bp, Homo sapiens
aaggtcgtgaaaaaaaagtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatggtttgtcaataaacttatgacct

SEQ ID NO: 51349 - DNA, 159 bp, Homo sapiens
attttttcctggtataaaaaggagccagtaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgt

SEQ ID NO: 51350 - DNA, 550 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggggattaaaagaccttgaaatccatgacgcagggagaattgcgtcatttaaagcctagttaacgcatttactaaacgcagac

SEQ ID NO: 51351 - DNA, 363 bp, Homo sapiens
  misc_feature 6: n = A,T,C or G
aaacgngagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggaggggaaggttctgagcaataaagtttcttagatcaatctaaaaagaaaaaa

SEQ ID NO: 51352 - DNA, 530 bp, Homo sapiens
tgaggaaatttaattcccttgccttccccaccacattcctcccgtttcagggtctaaatgttcctaattgcagtacagaggcatcttctcagagagcggtcctcagggacacttcccactctcctcagctctgcagtttctagtggcttccttcagtgacattcctacttttcattgactcttgagatattatattaaaatggaagatttattcccctggcagaaattgaggtcattgatattcagggaaaggtgcagtgcctctccagttatcctgcaactctttgtcaaaccctgcagagtgattaataggaaagtgttcgacaagggtcactcgcagagggcggggactctggttcaaaccacactgtgtgctctcacccaagtgcgcacttataatcaataatagatactgcaagaggacatactgtgtagcaagcacagggctacatagattctattccttattttattgaatcctcaaaacgaatctttaaattgggggaggggtaagtccctactttaaaaat

SEQ ID NO: 51353 - DNA, 580 bp, Homo sapiens
  misc_feature 555: n = A,T,C or G
gagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatactttacagagcttactttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtactttctgcaacagattgaagaattagggtctgaaggaaaagtagaanaagccccaggggatgatgaattagt

SEQ ID NO: 51354 - DNA, 290 bp, Homo sapiens
  misc_feature 166, 264, 268: n = A,T,C or G
cgtcttctgaaatgtggattccagaatgattgcttaggaactgacaacaaagcggggtttgtaagggaagccaggttggggaataggagctcttaaataatgtgtcacaagtgcatggtggcctctggtgggtttcaagttgaggttgatcttgatctacaattcnttgggaaaaggaagcaatgcagacacgagaaggagggctcagccttgctgagacactttcttttgtgtttacatcatgccaggggcttcattcagggnggcnggtgctctgactgcaatttttc

SEQ ID NO: 51355 - DNA, 380 bp, Homo sapiens
  misc_feature 14, 29, 179, 181: n = A,T,C or G
aggctgaggcgagnaagatcgcttgaatncaggagcttaagaccagcctgggcaacacagtgagaccccagctctacaaaaaataaataatgagctgcatgtggtggtgtgcacctgtgatcctagctccgtgggaggctgaggtgggaggattgcttgatcccaggaggttaaggctnangtgagctgtgattgtgccactgcactccagcccaggcgatagggggagaccctctctcaaaaagaagaaaagtctttcttgaattcactatacagcaagtttttttttctttaacatctactttatacagaaatttgtatttattcagggttagttccaaatcacttctaggtataatttcatttatccttatcctgca

SEQ ID NO: 51356 - DNA, 390 bp, Homo sapiens
  misc_feature 28, 354, 364: n = A,T,C or G
ttctgcactgtaacgtgccgggcacgcnctaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccangagcatccgnggatattagacctattatactgtaag

SEQ ID NO: 51357 - DNA, 310 bp, Homo sapiens
agagcaagctcagaaagtgtgtgtaaggagggatgaggagaagcaaaaagaaaaaatgaaaattatgttatccaccttccaacagggggccccaaaggataaaacacaccagtattactctctgttacccagagacccacacactcccaaacaaagcctcccgagagccaaaacctataaagatcctaggcccccacttcctaagccatataaagaacataaggaggcaaagccgagaaacccaaaaatagagagaagagacagaatcaatgcttcaattgtgagaaagtaggccacttcaagaggtatt

SEQ ID NO: 51358 - DNA, 350 bp, Homo sapiens
  misc_feature 331: n = A,T,C or G
ttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatgccnatggctatattagtgctgc

SEQ ID NO: 51359 - DNA, 500 bp, Homo sapiens
aggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcacccattgcagatgcttaagtcaactattttaataaattgat

SEQ ID NO: 51360 - DNA, 421 bp, Homo sapiens
  misc_feature 145: n = A,T,C or G
tggagcacaaatatgaatgagattgttacacaaattgatgcacaaaataagctggaaaaatctgaggctggcttagcaggagctccagcccgtgctgtatcagctgtaaagaatatgaatcttcctgagatcccaagaaatatcnacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgattttttttttt

SEQ ID NO: 51361 - DNA, 115 bp, Homo sapiens
  misc_feature 50: n = A,T,C or G
gaaacagaaagaaactctgaagaaattgttacaagaagacacacccgtgnggaagttgcaagccaacaaaaaagttcaaggatctagaagacgattaagggaaggtcgttctcag

SEQ ID NO: 51362 - DNA, 100 bp, Homo sapiens
  misc_feature 12, 26, 31, 47, 78, 89: n = A,T,C or G
gcaaataacagntttcatttaaactnccttncccccgctcccccccnaaaaatttggaattttttttttttttcaaanacttctttaancaccctggttt

SEQ ID NO: 51363 - DNA, 630 bp, Homo sapiens
  misc_feature 11: n = A,T,C or G
atacaagcagnatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggagctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaag

SEQ ID NO: 51364 - DNA, 335 bp, Homo sapiens
taaggaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactatcaaaaaaaaaaaaaa

SEQ ID NO: 51365 - DNA, 143 bp, Homo sapiens
  misc_feature 89: n = A,T,C or G
agaaacgtttgcgggaagagaaaaaaagaagaagaagagaagaagaaagatgcaaaaaaaaagagacagataaacagaagaaaattgcngagaaagaagtaaggattaagcttcttaagaaacccaaaaaaaaaaaaaaaaaa

SEQ ID NO: 51366 - DNA, 456 bp, Homo sapiens
ggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagc

SEQ ID NO: 51367 - DNA, 451 bp, Homo sapiens
  misc_feature 25: n = A,T,C or G
aaaaattataaccaagcataatatngcaaggactaacccctataccttctgcataatgaattaactagaaataactttgcaaggagagccaaagctaagacccccgaaaccagacgagctacctgagaacagctaaaagagcacacccgtctatgtagcaaaatagtgggaagatttatagggtagaggcgacaaacctaccgagcctggtgatagctggttgtccaagatagaatcttagttcaactttaaatttgcccacaggaaccctctaaatccccttgtaaatttaactgttagtccaaagaggaacagctctttggacactaggaaaaaaccttgtaggagagagtaaaaaatttaacacccatagtaggcctaaaaagcagccaccaattaagaaagcgttcaagctcaacaccccactaccttaaaaaaaaaaaaaaaaaaa

SEQ ID NO: 51368 - DNA, 239 bp, Homo sapiens
  misc_feature 203, 218: n = A,T,C or G
gctttcaagtgcctttctgcagcttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcangtatccaaccaactnggttctgcttcaataaatctt

SEQ ID NO: 51369 - DNA, 520 bp, Homo sapiens
  misc_feature 24, 339, 433, 458: n = A,T,C or G
aatatgtgtgccttttgaattctntcagtttgtttacaaaaacagttgcttatagcatttcaatttggagctctaatagatgtagactctaatgttttaactattggattctgcttaacaatatttcttaagcatggtgaagcacctaaaaaaatcaggctggttttggttgaatactatcctctttgtgaaataccaccctgaaatatttatatttttattttcataatagtcactcaaaataattttaccagtggaatgtgttcctattgtatatatcttttaaaaactacaatcatgtatcctagaggaaaaatctatttaagaataaagggctgnttcaattttcctaatattttgttatcatctagcacttgccagtaaacaaacgataatagtagtcaaagtattaaaatatatctaaagaaattgnattgcattggtactatatttatggngactcaattatatgcagttttagcagtttaacactccagctcatgggagctcagtggaaatt

SEQ ID NO: 51370 - DNA, 497 bp, Homo sapiens
  misc_feature 468: n = A,T,C or G
tggccttgtgttgctggttcctatttagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgncttttcattttaataaaggtataatactt

SEQ ID NO: 51371 - DNA, 420 bp, Homo sapiens
  misc_feature 14, 187, 241, 243, 264, 324, 326, 332, 361: n = A,T,C or G
gattcataacaagngctatgtaaatgctaattgtatcaattaatattactgcctacttggagcttcaagtctaatttggggaaaataaagagcaacagaaaagagaacacttggtccaacacataaaaaggatgatgaggagtctgatgaggaagctgtgaagaaaaccaacaaatgtgtactaagnctgggaggggacagccaaagaccggagctttggagagatgaagtttaaacaagngncctacagagaacatggctcgngagcatttcaaaaagcatggggctgaacactactgggaccttgcgcctgagggaatctgngntagagnccactgattgagactactgcaagcccttngcctctcctcccttgcctttggctcttcaggccctctcacttattctatttcccaaccc

SEQ ID NO: 51372 - DNA, 510 bp, Homo sapiens
  misc_feature 15, 504: n = A,T,C or G
atggccgggctcatnaggagacaacatttaagtgggattttgaaggatgcataggagatttttagagggaagtatgatcttagaaagaagaaatgagagaacagcatgtacagagaccaggcggtgcccaacagcataatgtgcttccagagctctgagcatctatcagagtacaacaccagagtaggtggggcagaaaaagtcaagatgagcctgcaaaaacaggcaaggcttgaaatagcaatgactttcttgcgtgaattctttctatcaaaaataagtttccatacactgtcaagacagtctattgcctcacttttctgcttggtaattctgatgggaaaagttttcaggaaacatccaggaagttttgcctaattaaaaatttaaagagactaagttcatcttttcaaataaagtatccccaaagcatgtttcctcaacttatgagaacagtaataataataataataaccaaagaacaaccttttttttttttcatgngacatc

SEQ ID NO: 51373 - DNA, 968 bp, Homo sapiens
  misc_feature 6, 18, 601, 611, 628, 659, 680, 716, 759, 765, 780, 788,801, 805, 823, 828, 844, 846, 847, 876, 891, 892, 893, 899,909, 921, 922, 927, 934: n = A,T,C or G
ttcccngggaattcggcnttatggccgggcatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgactttcaggaacctgaaacatcagcacaaagaagcaatcatcaaataaattctgaacacaaatttaatatttttttttctgaatgagaaacatgangggaaattgngggggttagcctcctgnggtaaaggaattggaagaaaatataacaccntacaccctttttcatcttganattaaaagttctggctaacttttggaatccatttanagaaaaatccttggcaccagattcattacaattcaaattgaanagttgngaactgttatcccanttgaaaanaccgagccttggntgtntttgttatgggatccctnaaaangcccgcagggcatttntnntttccttgggaaagctaagttataaaaanaggggggttgggggnnnaaaaantttttatttnaaaaggctttgnnaattnttttttnaggggggttactgggaaaattttttttttttttc

SEQ ID NO: 51374 - DNA, 470 bp, Homo sapiens
  misc_feature 355: n = A,T,C or G
atagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcattttggatgtgtaagtcttttgtaaaggcaagaataaataatatctaggacaatttattaagttttctcagtattttcccaaatattagaatatttacttcattattgggntggctgccaatgaccccatatgttctgtgagaatagtagcttatctttgatataatacatagtctccaaataggtaatacttcgcaattgattagatttttcagagtagatttaa

SEQ ID NO: 51375 - DNA, 470 bp, Homo sapiens
tcgaatttggggaactgtaagcagcatgacatgtttagagtgcaggcattcaaagcccaccaacccattttaaacaagggaagaaaatgcacgactttctgctttagaacaactgcccttgggacagtacagaagaggaaatgaagaagaggaagtctagaggaagtgggaacagtttattgactattacaatagtccaagcaaaagataatgagaacgtaaattagggaaggaaaagtaggaatggagaagaaataatgatttaaaaacatttaagggatccttctaacaaaacccagtgattagtggtacatctggaatgagggattattccaaggtttattatttagataataggtgactcatgcagagactaaacacaggaaaaacaattttcaggaaaaattagaaaagttgctatttatacatgttaaatttggagttttgtctataacagatctgtctactga

SEQ ID NO: 51376 - DNA, 252 bp, Homo sapiens
atattaatttcatctgaagacgtcctccactcatgagcagtcccctccctaggacttaaaactgatgccatcccaggccgactaaatcaagcaacagtaacatcaaaccgaccagggttattctatggccaatgctctgaaatttgtggatctaaccatagctttatgcccattgtcctagaaatggttccactaaaatatttcgaaaactgatctgcttcaataatttaatttaaaaaaaaaaaaaaaaaa

SEQ ID NO: 51377 - DNA, 180 bp, Homo sapiens
gaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaaaaaaaaaaaaaaaaaaaaaaaaaa

SEQ ID NO: 51378 - DNA, 480 bp, Homo sapiens
  misc_feature 24: n = A,T,C or G
tgtattctatgagtcccagaagtncgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttggggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatggggttgaaatttaacctttgtaagcttgt

SEQ ID NO: 51379 - DNA, 345 bp, Homo sapiens
gctgcgctgttggcacgaacaccttcgggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaaaaaaaa

SEQ ID NO: 51380 - DNA, 280 bp, Homo sapiens
  misc_feature 225, 276: n = A,T,C or G
gacattcagactgagcgtgcctaccaaaagcagcccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggngaccaagatgaagatgcagaggaccattgtcatccgccgagactatctgcnctac

SEQ ID NO: 51381 - DNA, 100 bp, Homo sapiens
gcttgcactgttaaataaagcttatccctaatacctgcctgcccaatcttaatcaggcggcggaagaacggactcatatctggacgttacaattgtgcat

SEQ ID NO: 51382 - DNA, 400 bp, Homo sapiens
  misc_feature 24: n = A,T,C or G
gtgtgaaaaaacaactgatgtgantaaaagtaaattctgtgaagctgatgcctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactgtgatcctcctgagttccagaccattattattggagataataaaactcagtaccacatggggtatttcagggattctcctgatgaatttcctgtatatgttggataaatgaagcaaaga

SEQ ID NO: 51383 - DNA, 400 bp, Homo sapiens
  misc_feature 26, 221: n = A,T,C or G
actgtaacacagttacagcagttgcntcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttggcagaaacactgaacagagttttgtcttttctaatccttgntagactactgatttaaagaaggaaaaaaaaagccaactctgtagactccttcagagtttagttttataataaaaactgtttgaataattagacctttacattcctgaagataaacatgtaatcttttatcttattttgctcaataaaattgttcagaaggtcaaagtggtaaagacaat

SEQ ID NO: 51384 - DNA, 300 bp, Homo sapiens
  misc_feature 275: n = A,T,C or G
aattgtttttactttgtgaaagctgctattttacggaaagattttgattactacagtttgtttttaaattgtcttttatatgtatttggtaagaatcggttgttacacaagctgttctttcccagttacaaaatcctgtgttcggttgtaaccctgaactcattaaaagacttgttttcaggtttatcaactgtttattttcactgacatttgagcatgttattttataaatgacgagattccagggtaggaagtgctttttattccccttttgntttttcttttaaaaaattacgtcag

SEQ ID NO: 51385 - DNA, 338 bp, Homo sapiens
taacagggatccaagatctttgccgttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagcctgggcaacaagagtgaaactccgtctcaaaaaaaaaaaaaaaa

SEQ ID NO: 51386 - DNA, 440 bp, Homo sapiens
  misc_feature 24, 368, 404: n = A,T,C or G
gtatgctcatacttggacagttanggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgngttttcatctcctaaaagtgttttttatttccttgnatctgtagtcttttattttttaaatgactgctgaat

SEQ ID NO: 51387 - DNA, 110 bp, Homo sapiens
tcttctctgtaggatgcaaaacatttcagttgtaatgtataagcatgcacttcatactagcaatcacagcacaggaggacagcattaaattttatatagccaaaaaaaaa

SEQ ID NO: 51388 - DNA, 350 bp, Homo sapiens
  misc_feature 93, 132, 138, 185, 259, 300, 337: n = A,T,C or G
atatgcagccaaccaagatgcaaatgttttgaaatgatatgaccaaaattttaagtaggaaagtcacccaaacacttctgctttcacttaagngtctggcccgcaatactgtaggaacaagcatgatcttgntactgngatattttaaatatccacagtactcactttttccaaatgatcctagnaattgcctagaaatatctttctcttacctggtatttatcaatttttcccagtatttttatacggaaaaaattgnattgaaaacacttagtatgcaggtgataagaggaatttggnataattatggggggggattattttttatactggatgngccaaagctttac

SEQ ID NO: 51389 - DNA, 380 bp, Homo sapiens
  misc_feature 24: n = A,T,C or G
gtaatgtaaatgtggagaagtttnaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatccagtctcaagtatagcgagattctttctaaatgttattcaagattgagttctcactagtgtttttttaatcctaaaaaagtaatgttttggattttgtgacagtcaaaaggacgtgcaaaagtctagccttgccccg

SEQ ID NO: 51390 - DNA, 470 bp, Homo sapiens
gaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcaccgacaaggaagatttgcatgatatgcttgcttcattggggaagaatccaactgatgagtatctagatgccatgatgaatgaggctccaggccccatcaatttcaccatgttcctcaccatgtttggtggagaagttaaatggcacagatcctgaagatgtcatcagaaatgcctttgcttgctttgatgaagaagcaactggccccatacaggaagattacttgagagagctgctgacaaccatgggggatcggtttacagatgaggaagtggatgaacctg

SEQ ID NO: 51391 - DNA, 360 bp, Homo sapiens
aaaacaatttattttaaatgtccaatttttggttattcttggcaagccgatggtactttttgcataatcttttgtggattcttggttgtactgtagttgcatgcatgattatagctcttgtttttctcacagtttctttaaaaatctttattagtggctataatgacgtggaaatgtaatctgtgttttctggtttttcatttatttggccaaaatgttatattaatggagttattgctatttttgctgtgataatggtattatgcaagaccatattctcaattatttggatatgcaaactaaagtattaagagctaatgtcattatatatgtaacttaaatctagacaccatcaaagca

SEQ ID NO: 51392 - DNA, 500 bp, Homo sapiens
  misc_feature 5: n = A,T,C or G
acggntctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaacctaaaaatgcagaaccattgatcaatttggatgtaaataatcctgattttaaggctggtgtgatggctttggctaacctgcttcagattcagcgtcatgatgattacctggtaatgcttaaggcaattcggattttgggtcaggagcgcctgacacaggatgcagttgcttaaggca

SEQ ID NO: 51393 - DNA, 400 bp, Homo sapiens
  misc_feature 23, 49: n = A,T,C or G
aattctcaactctccttttcctntttgaatttctttggtgctgtagaanacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttgggtaataataaaatgcctttgtatatattgatggtgaagagttcaattatttggatgtcgccaacaaaattctcagagggcaaa

SEQ ID NO: 51394 - DNA, 420 bp, Homo sapiens
  misc_feature 26: n = A,T,C or G
ttgtcaaactatccctttatgcaacncgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgagtgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagag

SEQ ID NO: 51395 - DNA, 540 bp, Homo sapiens
  misc_feature 22: n = A,T,C or G
attgaaggtgaacctgaattcnttctgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgtagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatt

SEQ ID NO: 51396 - DNA, 440 bp, Homo sapiens
  misc_feature 10, 35: n = A,T,C or G
aaaattaagnctcccaagtgtgacttggacaaagnagagcagatgcaccagtgcctgtgccataaagttccgaatcccccatgtgtctctttcagagctggccagaccggaaataaatcattctcataaattcagtgtgtactcagaacacatacacaacaacataggggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttaagaggtgttaataaaatcctcatcggaaaagatccaaagtgcaaggatttgattataaacataatttcctagactgaaagtttttggaaaagatgcagggtctgagtcaggccttc

SEQ ID NO: 51397 - DNA, 170 bp, Homo sapiens
  misc_feature 52, 152, 157: n = A,T,C or G
tttttctgagcagtaggactgaccagtgggcttaaaatattcagtaaccctngctataaacagatgtgctgtcatccagcctttgttttccatgtctagatcacaggcagagtagatttagcataattcttaagggccctaggatttttggnatagnaaatgagcattgg

SEQ ID NO: 51398 - DNA, 390 bp, Homo sapiens
  misc_feature 183, 280, 374, 385: n = A,T,C or G
gcaagtgtcggatccgcaggcgcacccgtgcgatgttgtcctctacagccatgtattcggctcctggcagagacttggggatggaaccgcacagagccgcgggccctttgcagctgcgattttcgccctacgttttcaacggaggtactatactggcaattgctgagagaagattttgcaatngttgcttctgatactcgaattgagtgaaggggttttcaattcatacgcgggatagccccaaatgttacaaatttaacagacaaaaacagtcatttgnatgcagcgggtttttcatggagaactgtctttacgcctgacaaaggatttattgaaagcaaagactaaaagaatgtataaagccattccaatanataggggcccnttgac

SEQ ID NO: 51399 - DNA, 500 bp, Homo sapiens
  misc_feature 25, 389, 472: n = A,T,C or G
gtttaaaaataaattgtgttttgcnctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaacgtgtaaatgtcagtaatcacttcatgaacgctaaatgagaatgtaagtatttttaaatgtgtgtatttcaaatttgtttgactaattctggaattacaagatttctatgcaggatttaccttcatcctgtgcatgtttcccaaactgtgaggagggaangctcagagatcgagcttctcctctgagttctaacaaaatggtgctttgagggtcaagcctttaggaaggggcagctttgttgnccctttgagctttctggtatgtgcctat

SEQ ID NO: 51400 - DNA, 410 bp, Homo sapiens
  misc_feature 23, 403: n = A,T,C or G
gctgagggggcaggcggagcttnaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattngaaggcg

SEQ ID NO: 51401 - DNA, 490 bp, Homo sapiens
  misc_feature 179: n = A,T,C or G
ggaagagctgttcaggttttgtccaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtnaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatctgcatactgacattttaaaacgtggctctgaaatggacaacaactgctcaccaaccaggaaagacttcactgaagataccatcccacgaacacagatagaaagaaggaaaacaagcctgtatttttccagc

SEQ ID NO: 51402 - DNA, 400 bp, Homo sapiens
  misc_feature 305, 314, 338, 349: n = A,T,C or G
gaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggnttttagtanggtttaataaatatttctctgagnaattcactggnttataataaatgtaatactcttttttataactatgttttactggatattta

SEQ ID NO: 51403 - DNA, 460 bp, Homo sapiens
  misc_feature 25, 26: n = A,T,C or G
atgtctcgctccgtggccttagccnngctcgcgctactctctctttctggcctggaggctatccagcgtaccccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactt

SEQ ID NO: 51404 - DNA, 216 bp, Homo sapiens
atgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcatgccaaccccatggcctccatgactttttcaaaaaaaaaaaaaaa

SEQ ID NO: 51405 - DNA, 320 bp, Homo sapiens
acattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttt

SEQ ID NO: 51406 - DNA, 500 bp, Homo sapiens
  misc_feature 434: n = A,T,C or G
ccgagcgaagcgatgcctaaatcccaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgtcctagntgttttaatctgtctttttacattggcttttgttttctaaatgttctccaagctattgtattgttt

SEQ ID NO: 51407 - DNA, 566 bp, Homo sapiens
  misc_feature 24, 51, 205, 433, 469, 475: n = A,T,C or G
acactgaataatggttttcatacnttttttgtaaaacattcttctcccccnttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattggtgnggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgntaagggtttcttctctttcattagctggccataagncaaggnccttataacactagggaaattaccctttttttactttcaaaattgcattataggggaattactggttacaaaatacacatactgggaacag

SEQ ID NO: 51408 - DNA, 400 bp, Homo sapiens
  misc_feature 341, 357: n = A,T,C or G
tggtcctgaaataaaatacactagcctttctactggaggtggagaaacagaggaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatttttttttttctgaatgagaaacatgagggaaattgnggagttagcctcctgnggaaaggaattgaagaaaatataacaccttacaccctttttca

SEQ ID NO: 51409 - DNA, 490 bp, Homo sapiens
  misc_feature 420: n = A,T,C or G
ggtgcggcgaacaccaaagtccggcaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtgggggggtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgntactaatttgcagaactctattaattgggtaggatttcacccattcctagctaagttcttaaaattaaac

SEQ ID NO: 51410 - DNA, 135 bp, Homo sapiens
  misc_feature 51: n = A,T,C or G
tgaagtaaaaaggaatactgtgttttggggagtactcttgtacagccagcncttttatgcaaaaatctatgcatttttacaatcttatattaaactggtattttcaaacaataggaaactttttttttttttttt

SEQ ID NO: 51411 - DNA, 130 bp, Homo sapiens
  misc_feature 53, 59, 113: n = A,T,C or G
tttaaatgctgacttgtttaccaccaatggcagaaacaggaaaagtgccctgnactgtntttggctctcaggtttaacttgcacagagcaaaattttatatcaaaatctgggnatcatcagtctgcttca

SEQ ID NO: 51412 - DNA, 170 bp, Homo sapiens
  misc_feature 23, 148: n = A,T,C or G
ggctcgtgcttgtagtcccagcnggaggctgaggcaggagtttcgcttgagcccaggagttggagttgaaggttgcagtgagctataattacatcactgcattccaacctgggcaatagagtagcggggtgggttggaggcgaaacangaataaaatgatacaacaaaaa

SEQ ID NO: 51413 - DNA, 130 bp, Homo sapiens
  misc_feature 109: n = A,T,C or G
atatcattgagcgcttgaagctggtgcccctgaatcaggaaagtgtggaagagagagtggctgctttcagaaatttcagtgatgaaatcaggcacaacctctcagaagngcttctttgccaccatgaaca

SEQ ID NO: 51414 - DNA, 380 bp, Homo sapiens
cattacaatatttgtactcataacccaaaatctgacctggttcgctttgtgcctctgtcagcctacttacagtgataaatgtacacacaagtccagtgttgccaaggagctttgtttatagaaagaagcttggtcccctcagttctatgctgttgtgtggcctggttggtacatgccgtcatgatgaaggatgactttggtttgagataatttgtcactccacattccatggagaaaagtgtttcattttgatgttggaaaaacatgaccagagaagcatgtgactcagataatgttccccggaagttgcagagcaatctgtgggtgtctgtcatagcccaactagtcctggagcacatggacaattctgtacccccaat

SEQ ID NO: 51415 - DNA, 375 bp, Homo sapiens
  misc_feature 17, 51: n = A,T,C or G
gaccaggcacatcaagnaagaacggtcaatccgacagattttgtacctcgncgacctgctggagacctgccatttccaggccttctggcaagccctggatgaaaacatggacctcttggaaggtataactggctttgaagactctgtccgaaagtttatctgccatgttgtgggtatcactttaccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgacccaaaaaa

SEQ ID NO: 51416 - DNA, 138 bp, Homo sapiens
  misc_feature 24: n = A,T,C or G
gggctgtgccaagtgtgcccaggnctgcatctgaaagggacgtcagacaagtgcagctgctgtgcctgatgccaggacagctgtgctctcagatgtaaatagagcaaccctatataaacctggatttttttttttttt

SEQ ID NO: 51417 - DNA, 100 bp, Homo sapiens
  misc_feature 46, 70, 81: n = A,T,C or G
aacaggaaacaggcccaagggcatactcgggttctttccaactcanaatcatctctgactccacaaaagngagtttagttncctatctgaattaacagct

SEQ ID NO: 51418 - DNA, 293 bp, Homo sapiens
gttgagcatgagcccataccatcattatagtgacaacattagaatctcctattaaccctttgagaattcaacttatttatacattactgaaagaaaatacaggtagggtgcatttcttcttagccttctaccccacccgctcacccactggcttttggttttgaggaaggcaatgcgtacaatacttcatgtacgcattaacttcatgttgttactcactgaatactgtgacttccatatctggtaaaacaaatattgagaagtcctataatttccaaaaaaaaaaaaaaaaa

SEQ ID NO: 51419 - DNA, 340 bp, Homo sapiens
  misc_feature 315, 330: n = A,T,C or G
aagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgnatctgctttgactgntggtgccttc

SEQ ID NO: 51420 - DNA, 380 bp, Homo sapiens
  misc_feature 210: n = A,T,C or G
atactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtatttttttcaagagaggnggcagcattcagcagtatatttataaacaggaacctgtacagaagtgccctggaagaaggcctgctctaaattatccagtgtatggagaaacgacacaggttacggagacgtcggctttgaacgtgctataggaccttctcaaacacacaccatcagaattcaatattca

SEQ ID NO: 51421 - DNA, 440 bp, Homo sapiens
ggacaaacggaagtgtaggttacggtctgagtacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacgagatacctgccacgcaaaagagttgaaggttgctaataatttatactggaatctggcatttttccaagccaagagaagatcgaatggctttttgcagctaactactatgtgtagacagggttttatattataaagtatgcattcttatcacctagtatatagttagtttgtaga

SEQ ID NO: 51422 - DNA, 350 bp, Homo sapiens
  misc_feature 32, 317, 336: n = A,T,C or G
gaaggcattgaggcagccagcgcaggggcttntgctgagggggcaggcggagcttgaggaaaccgcagataagtttttttctctttgaaagatagagattaatacaactacttaaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattganagaaaggactacagagccnccgaattaatacca

SEQ ID NO: 51423 - DNA, 380 bp, Homo sapiens
  misc_feature 347, 366: n = A,T,C or G
atgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtnggaacaagcatgatcttgntactgtgatatttt

SEQ ID NO: 51424 - DNA, 340 bp, Homo sapiens
  misc_feature 24, 309: n = A,T,C or G
tcggtggtggccctgcgcagaccnttacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaaagaggttggntcaagtttaaatgactgtgctgcccctttca

SEQ ID NO: 51425 - DNA, 285 bp, Homo sapiens
  misc_feature 30, 31: n = A,T,C or G
tagggaaaagttggtgaaacatgccagctnncaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcaaaaaaaaaaaaaaaaaaa

SEQ ID NO: 51426 - DNA, 330 bp, Homo sapiens
  misc_feature 25, 30, 31: n = A,T,C or G
caatcgagtgcttcatgcctttagnatgtnnaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaa

SEQ ID NO: 51427 - DNA, 450 bp, Homo sapiens
  misc_feature 28, 29, 34, 387: n = A,T,C or G
ctcctgtcattgattatgaactgattgnncaagnatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggaccgccgagataaggtcctgatcagaatcatggtctcccgcagtgaagtggacatgttgaaaattaggtctgaattcaagagaaagnacggcaagtcccctgtactattatatccagcaagacactaagggcgactaccagaaagcgctg

SEQ ID NO: 51428 - DNA, 410 bp, Homo sapiens
  misc_feature 7, 32, 271, 352: n = A,T,C or G
agaactntttcctattatttcagtcctttatnaaaggaaaaataaaccagtttttaaatgtatgtatataattctcccccatttacaatccttcatgtattacataagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggnttctttttaaaccattttttcttgttaatttacagttaaacctaggggacaatccgggattggccctcccccttttgtaantaacccaggaaatgtaataaattcattatcttagggggatcctgccctgccaatcaga

SEQ ID NO: 51429 - DNA, 400 bp, Homo sapiens
  misc_feature 25: n = A,T,C or G
gtggaaaatatatgttaacagtgcnaaacagttcaggaacaaaaacagcatttatcaatgtccgagttcttgacactcctggtgcaccacaaaaccttaccatcaaagaaatcacaaaagattctgtttcactcatctgggaccctccagtcattgatggtggatcaagaatcaggcattacattgtggaaaaacgtgaatctacaagaaaagcatattccattgtcaatgcctcttgtcctaaaacaagttggagaattggagatttacaagaaggaaatttgtatttcttcagaattttggcagaaaatgagtatggtgtaggtcttccagtagagacaatggaagctataaaaatctctgagagacctcttcctccaggaaaagttactctagaaga

SEQ ID NO: 51430 - DNA, 300 bp, Homo sapiens
  misc_feature 2, 17, 236: n = A,T,C or G
anaaggtctgactgatngctttgagctgtttgtcatgaagaaagagatatgcaatgcgtatactgagctgaatgatcccatgcggcagcgggagctttttgaagaacaggccaaggccaaggctgcaggtgatgatgaggccatgttcatagatgaaaacttctgtactgccctggaatatgggcctgccccctcacagctggctgggggcatgggcattgatcgagtcgccatgnttctcacggactccaacaaccatcaaggaagtacttctgtttcctgcccatgaaacccgaagac

SEQ ID NO: 51431 - DNA, 480 bp, Homo sapiens
  misc_feature 422: n = A,T,C or G
gatccactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttggggcagtcctgatttaaaactaagactggcttggggttaaatgaatattgttcagtttttgaattttaacagtaactccaattcagtaaatggtatcactgtttaccccttttaaagatatgattagacttcgttagtaatgttcaacttttcacaaaagatggngagtgccatcttaaaacttactggagaattggttttatatttagattttatataactg

SEQ ID NO: 51432 - DNA, 440 bp, Homo sapiens
  misc_feature 24, 26, 133, 263, 352: n = A,T,C or G
gaaggagcggcggcgacggaggantnaggatggaggcggtggtgttcgtcttctctctcctcgattgttgcgcgctcatcttcctctcggtctacttcataattacattgtctgatttagaatgtgattacanttaatgctagatcatgttgctcaaaattaaaacaagtgggtaattccagaattgattggccataccattgtcactgtattactgctcatgtcattgcacctggttcatcttcccttctcaacttacctgntgccacttggaatatatatcgtatgatcttagctttgataaatgactgaagctggagaagccgtggttgaagtcagcctacactacagngcacagttgaggagccagagacttcttaaatcatccttagaaccgtgaccatagcagtatatattttcctcttggaacaaaaaactat

SEQ ID NO: 51433 - DNA, 500 bp, Homo sapiens
  misc_feature 30, 432, 494: n = A,T,C or G
atgaccaaccaaaatatacctaaaggtatngtctctaggagttttattaatagtaaaggtaaaatctctcagtttcctacctctagaaagaggccatctcactagaataggatattatgcatactgagctagaccagaagagtctggaacaaaataaacacagcctttataatcaacttgaatactggtgttagctgagaactctgtaagtccctttaaaaattatgtatcttttggttcaagattaagaagcataatgacaacaaaaaaagcaggcagaatttatgaataagtgttgtttattattaaaacaataatttgttaatttcttataaggtcctgtgctataattactggtataaatataactgaatattggggtagctttcatttcttccattaattacatgtgtaaaattaaaacactactgnaatgttaatttcctgggtttgaaaatcatattatgggttatgtacattgttaacattaaggnaaagct

SEQ ID NO: 51434 - DNA, 600 bp, Homo sapiens
  misc_feature 3, 20, 28, 477, 572, 593: n = A,T,C or G
tcntccgggaggacaaccgnaccaaccncctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgnaattgtaccaagcagttaatcaccccaccatagggcatgatttaacaaaagcaaccttttcccttccccccgagtgatttttgcgaaaccccccnttttcccttcagcttgcttanaatggtt

SEQ ID NO: 51435 - DNA, 330 bp, Homo sapiens
  misc_feature 20, 94, 118, 284, 315: n = A,T,C or G
ttgagatgaagcttcttctngagtaaaaaatgtatttaaaagacaattgagagaaaggactacagagccccgaattaataccaatagaagggcnatgcttttagattaaaatgaaggngacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcngacgaaaatggaaagattaattgggagtggnaggatgaaacaaatt

SEQ ID NO: 51436 - DNA, 590 bp, Homo sapiens
  misc_feature 462, 560: n = A,T,C or G
aatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaaggtattctttggntgaattttattcttgatatggggcttaggagtgagatttctggtctacagaaatgatcatgctcatgaattttgacatttatcggcatgatgctttgnacaagggctgcaccaaatttagatcatctt

SEQ ID NO: 51437 - DNA, 600 bp, Homo sapiens
  misc_feature 499, 555, 575: n = A,T,C or G
gcgagtaatgaagactattctcagttttcagactgtcgacattccagaaaatgtcgacattactctgaagggacgcacagttatcgtgaagggccccagaggagccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcaggcggcttttgattcagcaangccacaacagttaaaaacaaggatatcaggaaatttttgggatgggaatcctatgnctctgaaaaagggacctgtncagcagggctgaggaataagatcct

SEQ ID NO: 51438 - DNA, 600 bp, Homo sapiens
  misc_feature 554: n = A,T,C or G
gtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagntgttctagtaacaatacatgagaaagatgtctatgtagctgaaaat

SEQ ID NO: 51439 - DNA, 460 bp, Homo sapiens
  misc_feature 26: n = A,T,C or G
gaaaggtgctatataattgtgaagtnttaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttgggggagttgttatgccatgattt

SEQ ID NO: 51440 - DNA, 339 bp, Homo sapiens
aggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttt

SEQ ID NO: 51441 - DNA, 540 bp, Homo sapiens
accaacaaacagaaaagaaaccctatatggttttagacttgttgagtttgaggaggtttccgttcaaaggaaaacagagaaggtagtaaggatatatgggtctggaacttcaaggagtttgggccaaagacataaatttaggattcattagattgtctatggttattgaggttgtgtaggacaggagtgaagaaaaacaagagaaggcagccttaagctgagccttgagggacctccaactctactggctgaagagcctgcaaaagggaacaaaaaggagaagctagaaaggaagggaaaaggccaacagggaatggtgttgcaaagatcaagggaagagagtgtttaagcagggagtgtttcatgctgagaggttaaaaataagaatgggataggaaaaatacctgaagatccctaaggcaaatgcattttctacaattaggtaattacaaatgtgcattttcctttttatttaggcacatctactatgcttcttactagaataaactgtgcagattggccttgatgtatgtactaagc

SEQ ID NO: 51442 - DNA, 244 bp, Homo sapiens
acctaccgagcctggtgatagttggttgtccaagatagaatcttagttcaactttaaatttgcccacagaaccctctaaatccccttgtaaatttaactgttagtccaaagaggaacagctctttggacactaggaaaaaaaccttgtagagagagtaaaaaatttaacacccatagtaggcctaaaagcagccaccaattaagaaagcgttcaagctcaacacccactacctaaaaaatccca

SEQ ID NO: 51443 - DNA, 460 bp, Homo sapiens
aaaaagtgtgctctatcataaaaataaattgaattgttcttctcaaagtggtggtgatggtaagtggtagggggagtgatgataagctccttcatgagctggcaaggccagtaattgcaaaggccactaaataaaaacaattcaaaatccttgaagccagatccctgcatgccactgacagcacccttaccacgacttcaactcccaacacaaatgtatcttttagacttctgaacattcatcagtgctaaactttcagtgctcagttttgactttgtttttaattttcttattcttctggacatttggggaatgtaaattaaggggtttcagttcaagtttccatacatgactttgatacgcatatttgtcaactctgaacctactactagttataattggctgtacattgattaattccactaagaacataagtcgactttgcttagcactgggaagc

SEQ ID NO: 51444 - DNA, 540 bp, Homo sapiens
  misc_feature 24, 25, 440: n = A,T,C or G
gctgagggggcaggcggagcttgnngaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggngattaaaagaccttgaaatccatgacgcaggggagaattgcgtcatttaaagcctagttaacgcatttactaaacgcagacgaaaatggaaagattaatt

SEQ ID NO: 51445 - DNA, 589 bp, Homo sapiens
  misc_feature 9, 510, 513, 521: n = A,T,C or G
agcgtaccnttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtctcatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgnagntagctccntaaagtacaaatgaagaaggccaaaaattatttgctattggcaggataagaaagcctaaaattgagtt

SEQ ID NO: 51446 - DNA, 320 bp, Homo sapiens
  misc_feature 24, 25: n = A,T,C or G
ttacaatggcctgaagcattcagnncagtcacatgcgagcaggtatgcagcctaggagcaataggccacaccacacagcctaggtgtgcggcaggtgtagcgcacttctgatgcctgcaccgacgacaaaatcaactaacagcaaactcctcagaccgtatccccatcattaagcaacacatgactgcagtttctttctttgcttctaggctcagcctacaaaagcttgctgctcatgctgcccggagcagagctctgaacttctaattctgagggctgcccgattcccaaactgttctttgctcaaataaacttatctg

SEQ ID NO: 51447 - DNA, 429 bp, Homo sapiens
gaagctgtatgggacttggttatatttcactggctttgtttatgtgactgcgtgtgtttgaaggataatcttttattcattcaacatatatttactgtgtacttactactgtgtgccaggcataatttgaaattctaggctcagagcagtgaataaaacagataaaaattctctgtccttatggagcttacattctagtatatggagcagataatagacaagctacatgatgaaatcctgtctttaataaaattacaaacattagccgggcgtggtggtgcatgcctgtagtcacagctactcaggaggttgaggcaggagaatcacttgaacctgggaggcagaggtcgcagcgagccaagatcacgccattgcactccagcctgggtgacaaagcaagactctcaaaaaaagaaaaaaaaaatggac

SEQ ID NO: 51448 - DNA, 347 bp, Homo sapiens
  misc_feature 25, 107, 271: n = A,T,C or G
ctagtaatgaaattattgatcatanggacaatgtatattacttgttctccatgatgcttggctggtttcccaaatgtttatgttgttttgatttcgtttttgctacntgtaaacacacttgcaagtggacaaactatgcctgttgatagagcagagctctgttgattaatatgttataattatacttatataattatactcatattgtattcgcaaaagcccccctattttaacctattggattttgtaacatttaattcatttttctggnttgtttaattgtgggcaaaatacagaaaggaactaagaaaaaggataaaaatatccaaaggaggtacattttgagg

SEQ ID NO: 51449 - DNA, 298 bp, Homo sapiens
  misc_feature 24, 25, 51: n = A,T,C or G
tgattatagaaggctgtcttagtnntaaaaacatacttacatttcagacanatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccctgc

SEQ ID NO: 51450 - DNA, 130 bp, Homo sapiens
  misc_feature 91, 101, 103: n = A,T,C or G
gcaaggagagccaaagctaagacccccgaaaccagacgagctacctaagaacagctaaaagagcacacccgttctatgtagcaaaaatagngggaagatgnanaggggagaggcgacaaacctaccgagc

SEQ ID NO: 51451 - DNA, 220 bp, Homo sapiens
  misc_feature 28, 128, 136, 191: n = A,T,C or G
cgcatggcagacccatggctggcgcagntgcctgttgccgtctgtcttcagtaactgctgctctgttaactgttctattctgatactacgcgtgtgtgttttttacaacaggtatgtttttgtttcanaaatatgnattgcttttctcatattttttgcaaattgaattgtcaacatgggtcatttaaagncctgtatgaaccataacctgctggggacc

SEQ ID NO: 51452 - DNA, 540 bp, Homo sapiens
  misc_feature 213, 323, 413, 530: n = A,T,C or G
catgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacatntgaagttaaacacaaaattatcagtgttttagaaacatgagtccggactgtgtaagtaaaagtacaaacattgtttccaccataaaagtatgtattgaaatcaaagttgnctctgtgtacaagaatacatacttattcccattttttaagcattttgcttctgttttcccctacctagaatgtcagatggtttttcaggntattctccccattttgtcaaaaggtggacctcaaggataccatttttcatttaaagcattctgaagatcttaagaaccccaatttattatttctaaccaatgggattattaagctcntttcaccctt

SEQ ID NO: 51453 - DNA, 450 bp, Homo sapiens
  misc_feature 231, 281, 388: n = A,T,C or G
aatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggntatgtttttctgtgtgtcaagttttcatagtatccatattttattactgnttattacttccatgaattttaaaatctgagggaaatgttttgtaaacatttattttttttaaagaaaagatgaaaggcaggcctatttcatcacaagaacacacacntatacacgaatagacatcaaactcaatgctttatttgtaaatttaggggttttttatttcta

SEQ ID NO: 51454 - DNA, 129 bp, Homo sapiens
ttttctcattcagttttgggaggaaaagggactgtgcattgagttggttcctgctcccccaaaccatgttaaacgtggctaacagtgtaggtacagaactataaaaaaaaaaaaaaaaaaaaaaaaaaa

SEQ ID NO: 51455 - DNA, 206 bp, Homo sapiens
gcaaatgtgaaaatagtttcaatactatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaatttctaaaaaaaaaaaaaaa

SEQ ID NO: 51456 - DNA, 530 bp, Homo sapiens
  misc_feature 6, 33, 423: n = A,T,C or G
ataacntttctataacttgtgatggacaagtantatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggnggctcctgccacctgctaatagcagttcaaactaaattttttgtatcaagtccctgaatggaagtatgaccgttgggtcccctctgaaggttaattctgagttctca

SEQ ID NO: 51457 - DNA, 390 bp, Homo sapiens
  misc_feature 203, 205, 228, 232: n = A,T,C or G
ttttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgngnactggatattcttctatttctgnatgnggtccctgagctctgctctgggattccggtaaatgatgtggataaaaatgatcagtatttaatctaaggctaattatttccccacactgaggcaagaccttttctgagcactgcggcccaatgtcccatgacaataaacatagcccctgaggtaaccc

SEQ ID NO: 51458 - DNA, 484 bp, Homo sapiens
tgatgcagctagccctgaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaaaaaaaaaaaaaaaaaaaaaa

SEQ ID NO: 51459 - DNA, 600 bp, Homo sapiens
  misc_feature 600: n = A,T,C or G
ataggtcaaaactggcaatattctcttgtctgcaagataaagtgtttgtgcttctatcaccatatgcatgaacatgtaagaatcagatacaatttctgcttcatcagtttcacatgttcatgttgtcactgaaaaaatgcatctactgtttatagctcccaaggagaccccaaatcctttttttttcttttgagatggagtcttgctcttgttgcccaggctggagagcagtagcgcgatctcagctcactgcaacccccacctcctgggttcaagtgattctcctgcctcagcctccccagtagctgggatttacaggtgcccgctaccatgcctggctaatttttgtatttttagtagagacaggctttcaccatgttggccaggctgatctcaaactcctgacctcaggtgatccacccacctcggcctccgaaagtgctgggattacagggagtgagccaccgcgcctggccccgtattcattttttatactggaaaacattttttttgggaatttttctttgcaaagaaatgagcataaaaatgaatactccaaagaaaaggaattatttatggcaaaattaaaagggacacggn

SEQ ID NO: 51460 - DNA, 304 bp, Homo sapiens
  misc_feature 22: n = A,T,C or G
acggttcgtttttcctttagtnggaaggacgttggtgttgagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagttcgtcactgacttgtgttcctgaactatgacacatgaatatgtgggctaagaaatagttcctcttgataaataaacaattaacaaatgaaaaaaaaaaaaaaaa

SEQ ID NO: 51461 - DNA, 576 bp, Homo sapiens
  misc_feature 389: n = A,T,C or G
aggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggnatgtgttttgtgtgcatgaatggacattgtaaatgttgaattctaggctccgacaatcattgtcaacagaagatcaagctgcaaatatttatgttttaaaacttaaattataaagctaggttaagtccttctaatgactagttttaatggtcatggggacatttttaccctaaggtacccggttacc

SEQ ID NO: 51462 - DNA, 410 bp, Homo sapiens
  misc_feature 28: n = A,T,C or G
ataggaaagcatatgcagccaaccaagnatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagataactgttttaataaaagatttacattctaaaaaaa

SEQ ID NO: 51463 - DNA, 580 bp, Homo sapiens
  misc_feature 13: n = A,T,C or G
ggcattcctgaanctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatggtaacatggacatgatcttctttataattctacttttgagggctggctccatggttt

SEQ ID NO: 51464 - DNA, 281 bp, Homo sapiens
taggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgaccaaaaaaaaaaaaaaaaaaaaa

SEQ ID NO: 51465 - DNA, 457 bp, Homo sapiens
ggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgaaaaaaaaaaaaaaaa

SEQ ID NO: 51466 - DNA, 160 bp, Homo sapiens
tctcacaggctgagaactcgttcacctccaagcatttcatgaaaaagctgcttcttattaatcatacaaactctcaccatgatgtgaagagtttcacaaatctttcaaaataaaaagtaatgacttagaaactgcgaaaaaaaaaaaaaaaaaaaaaaaa

SEQ ID NO: 51467 - DNA, 144 bp, Homo sapiens
  misc_feature 51: n = A,T,C or G
ggacctttccgagttggctgcagatttgtggtgcgttctgagccgtctgtnctgcgccaagatgcttcaaagtattattaaaaacgtatggatccccatgaagccctactacaccaaagtttaccaggagatttggataggaat

SEQ ID NO: 51468 - DNA, 640 bp, Homo sapiens
  misc_feature 18, 494, 561, 582, 594, 613, 621, 635: n = A,T,C or G
gggcgctaggcggcgacnctggcgtatacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgccctccataaccctgaactgngccgactccacaaaaacgattatgtactcttctgagatagaagatgctgttcttctgagagatacgntactctctccttggaatctgnggatttgaaganggctcctgccttctcacgngggaaatnagtgaaggggttanaaact

SEQ ID NO: 51469 - DNA, 600 bp, Homo sapiens
  misc_feature 9, 32, 57, 134, 497, 511, 558: n = A,T,C or G
agtactaanatggactaatctgtgggagcagnttattccagtatcacccagggtgcngccacaccgggactgtgttgaagggtgttttttttcttttaaatgtaatacctcctcatcttttcttcttacacagngtctgagaacatttacattatagataagtagtgcatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctggtttccaatgtgtccatttggatgtcagtgctatttcacgagntggacattgctcanattaaggttgacctcagtcccaaccaacatttccatttgatactcgnatgcttgatcttcaaaacaataaaattaaggaaatcaaagaa

SEQ ID NO: 51470 - DNA, 333 bp, Homo sapiens
  misc_feature 41: n = A,T,C or G
taatagaaaacaaccgaaaccaaataattcaagcgctgttnattacaattttactgggtctctattttaccctcctacaagcctcagagtacttcgagtctccctccaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtagtttgactatttctgtatgtctccatctattgatgagggtctt

SEQ ID NO: 51471 - DNA, 530 bp, Homo sapiens
  misc_feature 515: n = A,T,C or G
atattttagggacaaagctgaggactggttttaaataggctttaaaataaaagatcaatattatcctcatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatgggggtagaacttaggaaaaataaaggtgggtcttattcaatattttactttgcaaaattctagtaaaaggagagtatttantaaaatcataataaa

SEQ ID NO: 51472 - DNA, 470 bp, Homo sapiens
ataccactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacgcgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttc

SEQ ID NO: 51473 - DNA, 513 bp, Homo sapiens
gctactaaatgagggctgcacacttgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattctaaaaaaaaaaa

SEQ ID NO: 51474 - DNA, 600 bp, Homo sapiens
  misc_feature 249, 314, 402, 470, 535: n = A,T,C or G
tgaagaagaagctttcttggcttggaaagaagatataacccaagagtttccgggaaaaggcaaggctttgttccaggtgaatcacgtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaantatttaaagcagaagcacgtcagttaggatttccttctgcataaggtttttttgtagtgtaatgncttaatcatagtctaccatcaaatattttaggagtatctttaatgtttagatagtatattagcagcatgcaataattacatcataagntctcaagcagaggcaagtctattgcaaggaccttctttgctgccagttatcataggctggtttaaggntagaaaactgaatagcaacactgaatactgtagaaatgcactttgctcagaaatacttgaggtgntgcaatattttgattatccatttgggtgggaccagaaaaattcttaactgtaatttgatgggtgg

SEQ ID NO: 51475 - DNA, 130 bp, Homo sapiens
ggatgaattctgtgatcttactgtgactccgaaaactgtagtattggtgtcactgggaatgtacgttatttccaaagtcatttcattaaagatgaaaacttttaaaaaaaaaaaaaaaaaaaaaaaaaaa

SEQ ID NO: 51476 - DNA, 402 bp, Homo sapiens
tgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggggaaatggcatcattataagctatgagttgaaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaaggg

SEQ ID NO: 51477 - DNA, 334 bp, Homo sapiens
aatttagtccttagttacttctctagacttatctcttaccaggttttgtcagacttcatcatgcactacattaagttgcttgaactgtttcaaccatacttactaatttgcagctgcatttgctctggtgtctatgaaaacgcctttcttcctggaatcccctcatgcccctttcacttggaaacacataaacatcttttaagactcgtcttaagctactctaacccttcagcagaatacctcctctgaactttctcaagtagaattaatatcctttattataaaacaaacatctgttaaaaaataaaaatcatttaccaaaaaaaaaaaaaaa

SEQ ID NO: 51478 - DNA, 166 bp, Homo sapiens
aacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaa

SEQ ID NO: 51479 - DNA, 310 bp, Homo sapiens
  misc_feature 218, 242, 282, 295: n = A,T,C or G
ccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttnagcaaggactggtctttctatctnttgtactacactgaattcacccccactgaaaaagatgagnatgcctgccgggngaaccatgtgacttt

SEQ ID NO: 51480 - DNA, 357 bp, Homo sapiens
ctcgtgaatacaatttaacttcctttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaacc

SEQ ID NO: 51481 - DNA, 600 bp, Homo sapiens
  misc_feature 5, 13, 123, 575: n = A,T,C or G
gaggncttgaggnagccgcgcaggggcttctgctgagggggcaggcggagcttgaggaaaccgcagataagtttttttctctttgaaagatagagattaatacaactacttaaaaaatatagncaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagngggaggatgaaacaatttggagaag

SEQ ID NO: 51482 - DNA, 263 bp, Homo sapiens
  misc_feature 16: n = A,T,C or G
tcctaggctagtggangctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgacaaaaaaaaaaaaa

SEQ ID NO: 51483 - DNA, 100 bp, Homo sapiens
  misc_feature 67, 69: n = A,T,C or G
gcggggtttcagtcccagctgtatgcttgtaaatacccgccccgccaaaccgcatagagaacgtggnancaagctgagggtgctttgtttggggttatta

SEQ ID NO: 51484 - DNA, 580 bp, Homo sapiens
  misc_feature 503, 578: n = A,T,C or G
tcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtangggttataaataatggtaacatggacatgatcttctttataattctactttgagggctggctccatgtttgatgnat

SEQ ID NO: 51485 - DNA, 400 bp, Homo sapiens
  misc_feature 5, 258, 321, 375, 378, 397: n = A,T,C or G
aactnccagaattaaattttatatctgcatatttaacactattagctcatataaattataagaaaaattttcaaaggatctggttttaattttttggatatgaaatgaatttgccttttctgccttttcttaagtactattttgtaactatattgcactaactatatccaaaacacattctgagcatcactgtgagtaacagccttccagtttgtacccttttgattcacagcatggccctatagttaattaagaggnggataacttaagctcacaactgcctttaattttgatttcacatccacaggtattaaactttgnttttaaaaggaaaatgagacttttaaatagggtcctggtggttcacatataatnggnaaaacatattccccttggngga

SEQ ID NO: 51486 - DNA, 590 bp, Homo sapiens
  misc_feature 11, 15, 454, 484, 511, 515, 565, 571, 588: n = A,T,C or G
ataactcagangatnaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttggggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatggtaggtatagatttttctcacagatgccttttatcagattgaggaatttatattcctactttgccgaaggnttttgtagtatgaggggggctgaattttgncaaacactttttcggaataattgaaangatnggtctgcagcatcggatggggatttctccttattctgtcgggaggatacnctggtngctaaggtaaacaaccnta

SEQ ID NO: 51487 - DNA, 305 bp, Homo sapiens
  misc_feature 4, 13, 30: n = A,T,C or G
aatnaatgatttntacttgatctttttatntgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaacc

SEQ ID NO: 51488 - DNA, 193 bp, Homo sapiens
  misc_feature 9: n = A,T,C or G
cacaaaagnagtaccagcttctcactgaacgaacacagtgcagcaccaggagtgacagaaggaggaggcggcagcggtggttgagggacagggtgcgtgcacgtccaagtacagttcttaaaatgttgagggcatacaacatatgctcaataaatacctgatttttaaaaaagacaaaaaaaaaaaaaaaaaa

SEQ ID NO: 51489 - DNA, 590 bp, Homo sapiens
  misc_feature 138: n = A,T,C or G
attgaggaatataagcctacaggtcatcagccttgaggtgattactgatgatttgggcttacacacatgtcagcaagatagggagtgtggataggggagggctggtagctaacaaggggcctcacagagaaatattangtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaaaaaaaa

SEQ ID NO: 51490 - DNA, 150 bp, Homo sapiens
  misc_feature 134: n = A,T,C or G
tgatattatcataataaatgagtgctattctataatgagagccttttagggaaattcttttaggccattctgggatcatgtggtgaaccacctttagaatgacattcaagtctccctgttttgaagaagttggnacctatactaactgct

SEQ ID NO: 51491 - DNA, 159 bp, Homo sapiens
tggctggtacacccctccaaaggaagatggctaaatatgttgactgttgtatgtttggactaatgttgctttaaagaaaatctttccaacatgcacgacaaaagctttgagtgcccctattacagcagtaccgaagatgttagttaatagatattttag

SEQ ID NO: 51492 - DNA, 335 bp, Homo sapiens
  misc_feature 18: n = A,T,C or G
ccgtctaaggtgtttganggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcc

SEQ ID NO: 51493 - DNA, 236 bp, Homo sapiens
atagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttgtaaataccaaagatgtaacaattttaaaattttctagattactccaataaagtgttttaagtttccaaaaaaaaaaaaaaaaaaaa

SEQ ID NO: 51494 - DNA, 600 bp, Homo sapiens
  misc_feature 537, 560: n = A,T,C or G
atagataggacattttaatagaacaaaattagcatttccagtccttcaaagctttgggtttctcatcatcatcactatggcatttcaacatcatctaatacttttgatttcaagaacatcccagctgtctagaatgactagttgctgctgagactgcttcttgcttatttcataaattgcatttatgagaaagaaatgcataccagagtccactgcagcttggtttgttcctttagtagtaagaagattcctacctaggttaggaggcattcccacagaccgtagtaactgctgagtacatttgaggagaataatagagggaaggtagccttaagaaaggcacatgggccggtgcgccagctcacgtctgtaatcccagcactttggaaggctgaggagggtggataacgaggtcaagagatcaagaccatcctggccaacatggtcaaaccccgtctctactaaaaatacaaaaattagctgggcgtggtggtgtgtgcccggtagtcccagctactcgggaggctgaggcagganaattgcatgaacctgggaggcanaggttgcagtgagctgaaattgggccattgcactccagcc

SEQ ID NO: 51495 - DNA, 488 bp, Homo sapiens
agaatataaaggaggcatcagaaaacacactctctaaagcccttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaatttggttcaagttcataaaaaaaaaaa

SEQ ID NO: 51496 - DNA, 550 bp, Homo sapiens
  misc_feature 442: n = A,T,C or G
aagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgaggggaaattgngggagttagcctcctgtggtaaaggaattgaagaaaatataacaccttacaccctttttcatcttgacattaaaagttctggctaactttggaatccattagagaaaa

SEQ ID NO: 51497 - DNA, 630 bp, Homo sapiens
  misc_feature 534, 548, 556, 593, 603, 620: n = A,T,C or G
aggtctgattccaaacttaatgactatatgcttaaattttcacctatagtttaatgaaatgtttgtttttaaaagatgtttgaagtctaaaatagactccccaaacagtgtctgacatgtaataagtcctcagaaaataattcataaatattgaatgactagtaggatattaaaatgtggtcattcctgctgtttacttttatctgagggcacaaatgtcaagaacaattctataggtgctagacctcctatataggacatgctaacaagcttgcaaaagtgtttatttcaaatttcgatctatcatctactttcagagcacattaagagtttatgagtgttcagagattgggaagtgagaattttttttatgaagtgacttgccagtgtacttcccatttcccaatatctttctgtgtcaataagcaaaagaacttctcttttaccttaagccaagtttggattctgtcatatattggcaagtgtcctctgggagttggaggttgcagaggtgaacactttcagtatgtgagnttggtagaactacncataaccncagagtaaaagcagatgtgtagattaagccacacttncagcaatggngaggctgaagggagggnttcctggggc

SEQ ID NO: 51498 - DNA, 369 bp, Homo sapiens
  misc_feature 174, 184, 191, 210, 212, 227, 229, 255, 257, 279, 283, 294,299, 354: n = A,T,C or G
taagggaagctgatacagagagacaacttgctcctttcctcagctttataataaactgtttaacgtgaggtttcagtagctccttggttttgcctctttaaattatgacgtgcacaaaccttcttttcaatgcaatgcatctgaaagttttgatacttgtaacttttttttttnggttgcaatngtttaanaatcatggatttatttttngnaactctttggctatngnccttgggtatcctgacagcgccatgngngtcagcccatgtcaatcaagangggngattatgaaangccanacttctaaaataaatgttttggaattcaatgggtaaataaatgctgctttggggnttttaaaaaaaaaaa

SEQ ID NO: 51499 - DNA, 670 bp, Homo sapiens
  misc_feature 4, 602: n = A,T,C or G
tttnaaatgtctaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattgggcatgccacaggggattctcctccttcatcctgtaaggncaacaataaaaccaaattatggggctgcttttggcacactagcatagaaaaggggtggaaattaactt

SEQ ID NO: 51500 - DNA, 150 bp, Homo sapiens
  misc_feature 17, 103, 115: n = A,T,C or G
cactgccttgacatganccccagcaagtttattcttttcattttcagtgatgttgggaatggactgggttttaaaagggggcttgccgaggggttgtttgacngtcacagatggntcctgcggccgatgcctcttttagccatttctcat

SEQ ID NO: 51501 - DNA, 170 bp, Homo sapiens
  misc_feature 34, 138, 158: n = A,T,C or G
caatcaatattgcatcctaagccccatgtttggntgggtgcagatagtttttgaaactaggtggtgacccaacttacaaatatgtcaccaggggtgacctaggaaaacagtctgatataagggaaagctcttctcagngagatgatttagacatttgnaagggcaggggc

SEQ ID NO: 51502 - DNA, 158 bp, Homo sapiens
aacggagtcttctgagaaggagacaatgtctgtaagtctaaatcagactgtaacacagttacagcagttgcttcaggcggtaaaccaacagctcacaaaggagaaagagcactaccaggtgttaggagtgaagtaattgggaaactgttcatttgagg

SEQ ID NO: 51503 - DNA, 126 bp, Homo sapiens
  misc_feature 11, 25, 73: n = A,T,C or G
aatttcaaagnaactatgaagaccntttgaagctctaatttatatagtcacctataaaatgttctttatatgngttcataagtaaattttatattgattaagttaaacttttgaattgatttgagg

SEQ ID NO: 51504 - DNA, 235 bp, Homo sapiens
  misc_feature 86, 163: n = A,T,C or G
cgtggcagaggtggtttttacctcggatagaggtttccagtttgtttcctcgtctcttccagatatttgttatcgctgtggtgagnctggtcatcttgccaaggattgtgatcttcaggaggatgcctgctataactgcggaggaggtggccacatttgcctnggactgcaaggagcccaagagagagcgagagcaattgctgctacaacctgtgggcttaccagggccatctgg

SEQ ID NO: 51505 - DNA, 140 bp, Homo sapiens
  misc_feature 33, 36, 53: n = A,T,C or G
caacgttgtattccaggaagaaaccggtctctngtngaaatccgaaatttctngggtgaaaaatatatccgcagggtccggatgagaccaggtgttgcttgttcaggcatctcaggcccagaaagatgaattaatccttg

SEQ ID NO: 51506 - DNA, 108 bp, Homo sapiens
  misc_feature 91: n = A,T,C or G
attaacatgaatgtaatgaagtatatactttccttagaaggttggttttaattttgggtgtgtaaatgatttgactcagggctcggggggngaaattggccatttttt

SEQ ID NO: 51507 - DNA, 103 bp, Homo sapiens
  misc_feature 31, 58, 83, 84: n = A,T,C or G
cctcgagaagattttggaaggctttgtgtgngtgcttagtttgttttttccctataanaaatctcaatcttgtctaggcttgnngtaaatatgtttacctatg

SEQ ID NO: 51508 - DNA, 230 bp, Homo sapiens
  misc_feature 26, 28, 183: n = A,T,C or G
aggaaattttctcatattatgttcancnaaagtatttacttcctaaaaatagaattcccgattctgtctattttggttgaataccagaacaaatctttccgttgcaatcccagtaaaacgaaagaaaaggaatatcttacagactgttcatattaagatgtatgtaggactgttaattttgcngtttccccatattttcctgcctatcttacccagataactttctttgg

SEQ ID NO: 51509 - DNA, 150 bp, Homo sapiens
ttaataagtaattatcattggttgcttttcaatataattgcgaacaaattaaaaacacagttaaactaatatgtttataagcttgagttttcttcctaccatatcactctcatatatcagtgatgaaatgtcaggattttgagcagtagc

SEQ ID NO: 51510 - DNA, 170 bp, Homo sapiens
  misc_feature 13, 20, 47, 51, 53, 68, 71, 77, 139, 155: n = A,T,C or G
tattaatattttngcctgtnaaaaagaaagggagcagggtaaggctnagtncnctttggaggtaggtnatnatgatnaggcttggtcactgttccactactcagcatggaaacaaggatgagattccatttgaagggtngggagacaaaattggnggatccattaagtaa

SEQ ID NO: 51511 - DNA, 340 bp, Homo sapiens
  misc_feature 59, 89, 212, 235, 257, 277: n = A,T,C or G
aggttttctcgctctagggaagacccttcaagcaatcactatgtcaacagaacacaggngtttcccttccttcatatgaggaagatcangggatcaaaactcattcgaaaagctaaagaggcaccattcgtacccgttggaatagcgggttttgcatgcaattgttgcatatggattatataaactgaagagcaggggaaatactaaaatgnccattcatctgatccacatgcgngtggagcccaaggctttgttgnagggagcaatgactgttggnatgggctattccatgtatcggggaattctggggcaaaacctaagccttagaagaagagatgct

SEQ ID NO: 51512 - DNA, 147 bp, Homo sapiens
  misc_feature 63, 94, 119: n = A,T,C or G
acaggctgacagagaagattcccgagagtaaatcatctttccaatccagaggaacaagcgtgnctctctgccaaggatccatctaaactggagngatgttagcagacccagcttagggntcttctttctttcttaagcccttgctct

SEQ ID NO: 51513 - DNA, 310 bp, Homo sapiens
  misc_feature 102, 131, 193, 268: n = A,T,C or G
ttttttaaagaaaaagaatgaaaggccggcctatttcatcacaagaacacacacatatacacgaatagacatcaaactcaatgctttatttgtaaatttagngtttttttatttctactgtcaaatgatgngcaaaaccttttactggttgcatggaaatcagccaagttttataatccttaaatcttaatgntcctcaaagcttggattaaatacatatggatggttactctcttgcaccaaattatcttgatacattcaaatttgnctgggtaaaaaataggggggaagatatttggaggccaggaat

SEQ ID NO: 51514 - DNA, 140 bp, Homo sapiens
  misc_feature 38, 84, 89, 119, 120, 121: n = A,T,C or G
ggaacccaaaaagcagtcactatcacactgacatctcnaattattcgagaagagaacatgagggaaggagatgtaacctcgggngtggngaaagacccaccggacgtcttggacaggcnnnaatgccttgacgctctggc

SEQ ID NO: 51515 - DNA, 325 bp, Homo sapiens
  misc_feature 24: n = A,T,C or G
taacaaataaattggaatttaaancctatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattagggcactactgattttttagttaaattgatgcactacacttttgatgtttgaagttacaaacctgtaatttttttgtaaaggaaataattgccaaatacctagggcccattgctgacgattagttctaaaatcttattcctcctcttct

SEQ ID NO: 51516 - DNA, 180 bp, Homo sapiens
  misc_feature 5, 41, 46, 117, 132, 133, 142, 165: n = A,T,C or G
tggcncgtactgttccgaacggcccccacctacccacatgnaactntttaagatttaaatttaaattagttaacattcaaaacgcagctccccaatcacactagcaacatttcaagngcttgagagccatgnntgattaggnggttaccctattgaataggtcangaagtagaatctttt

SEQ ID NO: 51517 - DNA, 137 bp, Homo sapiens
  misc_feature 63, 65, 85: n = A,T,C or G
tactcttccttccccccttccatttggaggagcggggtcactcctcctcccccccagggcttngnagtctctcctatgtcataanaaagctacattttctctgggaaaaaaaaaaaaaaaaaaaaaaaaaaaaaaaa

SEQ ID NO: 51518 - DNA, 229 bp, Homo sapiens
  misc_feature 1: n = A,T,C or G
naatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagca

SEQ ID NO: 51519 - DNA, 390 bp, Homo sapiens
  misc_feature 22, 191, 306, 363, 370: n = A,T,C or G
atcagcataaataaaatggtcnccgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggngtctagatttctaatgaagaatcatgatacagtttggattaagtatcttggactggttttaaacagtgctttgtacccggatctgctggaagcatctgtccagctggaatcctgnggaaagtttgttattttctgagtagacattcttatagaggattgggctttaaaatcnagattgncctcttctatattggaaagg

SEQ ID NO: 51520 - DNA, 320 bp, Homo sapiens
  misc_feature 24: n = A,T,C or G
tgtttaaaaagtgaacagtgcctncctgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctggaagatcgaagccctgtgaaaaaatgctacccaaatggcaaaaaagcaacaattaaacagtttgattt

SEQ ID NO: 51521 - DNA, 310 bp, Homo sapiens
  misc_feature 4, 187, 209, 250: n = A,T,C or G
gtgncgtgacaaggaaacttacaacctgcaacgcaggagaaaactattaaaggtattcaggaaacgtgaagccagcaattgtttcgcaattcggcattttgaaaacaaatttgccgtggaaactttaatttgttcttgaacagtcaagaaaaacattattggaggaaaaattaatatcacagcatancgcccacccctttacattttgngcagtgattatttttttttaaagtcttctttcatggtaagnagcaaacagggctttactatcttttcatcctcattaattcaattaaaaaccatttacctt

SEQ ID NO: 51522 - DNA, 400 bp, Homo sapiens
  misc_feature 138: n = A,T,C or G
ggctataaaaatattttataaatttgaaatacagactataaacataaactttcaacctcgtaagcaatcaggaaaattaaagttaaaatgagatactatttttcaatacattgaaatggcagattattaaagattggngatagtgctggagataatgtgaggaaaggagtattctcagtcattgtagaaattgatacagcttttggatggacagtttgacagtgtgtatcaacatgtgaaatgtctccagcctttgatctaatgactaattttaggcatccagcctgaagaaatattcacacaagtgcccaaagagtcagatacaagactgtgtgaagtgtttttttgagataataaaaaactagaaacagcataaaatgtacagaaatgcagaaaattg

SEQ ID NO: 51523 - DNA, 230 bp, Homo sapiens
  misc_feature 19, 174, 208: n = A,T,C or G
gctgaccaggaattctttncggacattggcccagtctgtttcaaataaatgaactcaatctaaattaaaaaagaaagaaatttgaaaaaactttctctttgccatttcttcttctttcttttttaactgaaagctgaatccttccatttcttctgcacatctacttgcttaaanggggggggcaaaaggagaaaaagaagggattggntcagagcattggggcaatacag

SEQ ID NO: 51524 - DNA, 270 bp, Homo sapiens
  misc_feature 24, 25, 26, 60, 121, 247, 261: n = A,T,C or G
attggtgaaaacatgaatccagannncatggttgctctattggactaccgtgaggatggngtgaccccatatatgattttctttaaggatggtttagaaatggaaaaatgttaacaaatgnggcaattattttggatctatcacctgtcatcattaactggcttcctgcttgtcatccacacaacaccaggacttaaggacaaatgggactgatgtcatcttgagctcttcatttatttttgactgngatttatttggagngggaggcat

SEQ ID NO: 51525 - DNA, 349 bp, Homo sapiens
  misc_feature 24, 349: n = A,T,C or G
agaaaaattcttaactgtaattcnatgggtgttgccgtaatagtatattgcctgtatttctacctctagtaatgggctttatgtgctagattttaatatccttgagcctgggcaagtgcacaagtctttttaaaagaaacatggtttactttgcacaaaactgatcagttttgagagatcgttaatgcccttgaagtggtttttgtgggtgtgaaaaaaatggtgagaatttgaattggtccctcctattatagtattgaaattaagtctacttaatttatcaagtcatgttcatgccctgattttatatacttggatctatcaataaacattgtgatacttgaaaaan

SEQ ID NO: 51526 - DNA, 380 bp, Homo sapiens
  misc_feature 25, 155, 196, 230, 358: n = A,T,C or G
gagttgagaattcaatttacctgcnttacctgaaatgttgaataagcaaaatatgagctgaaagcttacaatcttcataattactgccccacatcgccttctccaaatttcaggaaagagagaaaggggtttcctctcctcttcacccaggaacnttccctgaaaacctcacccaaagactttccctgacatgtcnctgctatccctaagagaaagaagggcaagcaacnttttttttttcttagcctggatacttttgcaatctcaatgaattaaggggatcagggtaataagggaagaaggggagaaacagataccttggcagggaaatggagcaggctctgtcatagatatgccngagttttaagggctggcatatc

SEQ ID NO: 51527 - DNA, 282 bp, Homo sapiens
agtttaatgccaatggattacatatttttagtcctgttggaatgttaaaccgatatgatctactaaattaaatagatatggattacagatgagatcatctatgatgttgagttaaaagttcacaataatgtaagaatgttcggcatggtacagtggctcatgcctgtaatcccagcactttggtaggccaatgcagaaggatcgcttgaggccaagagtttgagaccagcttgggcaacatagcaagacccgatctctacaaaaaaaaaaaaaaaaaaaaaa

SEQ ID NO: 51528 - DNA, 150 bp, Homo sapiens
  misc_feature 40, 92, 122, 132: n = A,T,C or G
caaagagcccttcgagcaccacgcccgtaagatccatcgnagagtcctaaagaagaacccactgaaaaacttgagaatcattgttgaagctnatcccatatgcgaagaccatgcgccggaanaccattcttngccaggccaggaatcaca

SEQ ID NO: 51529 - DNA, 280 bp, Homo sapiens
  misc_feature 279: n = A,T,C or G
ttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggccgaatcgtaatgaggcgtgcgccgccaatatgcactgtacattccacaagcattgccttctttattttacttcttttagctgtttaactttggaagatgcaaaggaggttggatcaaaggtttaaatgacttgng

SEQ ID NO: 51530 - DNA, 250 bp, Homo sapiens
agtgatttctatccaaaatatataaagcaactatttgaactaaataataaaagataaataactcaattaaaacatttacaaaggaactgaatagaattttttccaaagaacataagcaaatgatcaataagcacatgaatagatggtcaacattattaatcattagagaagtgcaacccgaaaccataatgagataccacttcacaccaaccaggatggctataatataaaaaaaaaaaaaaaaaaaaaa

SEQ ID NO: 51531 - DNA, 388 bp, Homo sapiens
  misc_feature 19, 78, 102, 119, 155, 166, 220, 241, 280, 313, 340: n = A,T,C or G
ctttggtctctgaactgcncttaggcaagaagtaaaaacagaaacgtcaaacgtcaaatgtttgctttgttacctggnggactaaatgtagatgtctttagnatactttgtatgttctnaatattggaagataattttgggaatctgtagatttnattttttcagncttaccttacaaatttcttttctatgaataatagaggacttacggcactctgcnattttgttaatgaaaggaagngcaggaggatttagaaaaagtacatgatcccccagaccncaacaaaccaaaaacataaactcatgtctgggncccatggtcataggtcaaagattttgnactgctaaaattaccaaataatttaaataaaggggggttttgagccct

SEQ ID NO: 51532 - DNA, 300 bp, Homo sapiens
  misc_feature 18, 25, 95, 148, 175, 179, 180, 246, 287: n = A,T,C or G
gtgttctcttcttggctngcgcccnattctctattgcttaggatattaaagtagagcactcaagtgtgggtttctgtgtaattgaggatttgttnggaattcgaattacagttatgtactggatgctacagacttataacagcatagngaatggtaagactagtgcaaaacaggntatnnctggaaaattaaagaccattatttgctacccaaatcaatggggactattttcataatgcattttgnccttttggtaaattttaaacaaaacaaagtatcatttaggngaatcaagctagc

SEQ ID NO: 51533 - DNA, 320 bp, Homo sapiens
  misc_feature 23, 271: n = A,T,C or G
ctgcccagcttcttggggaaaangacagatgaagttgctttccagaagctgatgagcaacttggacagcaacagggacaacgaggtggacttccgagagtactgtgtcttcctgtcctgcatcgccatgatgtgtaaccgaattctttgaaggcttcccagataagcagcccaggaagaaatgaaaactcctctgatgtggttggggggtctgccagctggggcccctccctgtcgccagtgggcacttttttttttccaccctggctccnttcagacacgtgcttgatgctgagcaagttcaataaaagattcttggga

SEQ ID NO: 51534 - DNA, 310 bp, Homo sapiens
  misc_feature 59, 267: n = A,T,C or G
aaagaaatatttttgcctagttcatgttgccaagcaatgcatattttttaaatttgtcntatatggaaagagcatgtttgttacatgtaaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatattttcatatcaacgnttatattgaaagtgaagggaaaatgattaatacaaggttttgt

SEQ ID NO: 51535 - DNA, 470 bp, Homo sapiens
  misc_feature 24, 307, 406: n = A,T,C or G
ggcagtatttgaagccgtgtccancccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaaagccaaaaaacctgcacttgntgccaagtcttccatcttactagatgtgaaacccttgggatgatgagacaagatatggcgaaattagaggagtgcgtcagaagcattcaagcagacggnttagtctgggacttatctaaactagttccagtgggataccggaattaagaaacttcaaatacag

SEQ ID NO: 51536 - DNA, 410 bp, Homo sapiens
cctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgacctttgtcacagcccaagatagttaagtgggatcgagacatgtaagcagcatcatggaggtttgaaga

SEQ ID NO: 51537 - DNA, 380 bp, Homo sapiens
  misc_feature 21, 124, 148, 174, 204, 218, 240, 261, 267, 316, 327, 345,352: n = A,T,C or G
gaagtttagaaatgcaggaancccttcaaccagcttgaatcactgaatatgcatttgagaaatcacattagattgaaaccctacgaatgcagtatatgtgggaaagcctttagtcataggtcgnccctgcttcaacatcacagtattnatactggagagaaaccttacgaatgngttaaatgtgggaagaccttcagctgtagntcaaaccttactgnacatcagagaattcatactggngaaaagccatataaatgtagngagggnggggaaagcttttagcaaaggctcgaatcttactgcccatcaaaagagnacataatgggngaggaaacccaatagtgngggaagnggggaaaagcctttagatcatatggaat

SEQ ID NO: 51538 - DNA, 229 bp, Homo sapiens
  misc_feature 157, 201, 212: n = A,T,C or G
tactgcatccttcaactctcactagaaaatcttttgaaaccaaatggattaatttatggctatttataatttgctttgacatctcactgttggaaattttttaaagatgagatttgcctttataatgtaaattatgatttttgttttacatgggggnttctatagttttaattttttcagcttttaagatacgagttttgngtaatttgggnatttttaatcatttatg

SEQ ID NO: 51539 - DNA, 330 bp, Homo sapiens
  misc_feature 180, 286, 287, 324: n = A,T,C or G
actgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgngttgctaacgaagccactcttaattaatatctgtatcctggaacaatattttatgggtatgtttttctgtgtgtcagttttcatagtatccatattttattactgnntattacttccatgaattttaaaatctgagggaaatgntttgta

SEQ ID NO: 51540 - DNA, 510 bp, Homo sapiens
  misc_feature 175, 402, 431, 433: n = A,T,C or G
ctggtaaaaagctggaagatgcccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagnggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaaatgcatcgtaaaaccttcagaaggaaagggagaatgttttgnggaccacctttggttttctttttttgcgngnggcaggttttaaggtattaggtttttaaaaatcaggacttttttaaatggaaacaactttgacccaaaaatttggca

SEQ ID NO: 51541 - DNA, 106 bp, Homo sapiens
  misc_feature 98: n = A,T,C or G
attttataatgaaagtatgtacccagtcaaatgcttactgtaaatgcataagagacgttaaaaataacactgcactttcaggaatgtttgcttatggncctgatta

SEQ ID NO: 51542 - DNA, 360 bp, Homo sapiens
  misc_feature 23, 25, 81, 214, 222, 343: n = A,T,C or G
cctcttcctgaatacggaggaancnttcgttatggactgatccctgaggaattcttccagtttctttatcctaaaactggngtaacaggaccctatgtactcggaactgggcttatcttgtacgctttatccaaagaaatatgtgattagcgcagagaccttcactgccctatcagtactaggtgtaatggtctatggaattaaaaaatatggnccctttgntgcagactttgctgataaactcaatgagcaaaaacttgcccaactagaagaggcgaagaaggcttccatccaacacatccagaatgcaatttgatacggagaagtcacaacaggcactggntcagaagcgccattacc

SEQ ID NO: 51543 - DNA, 510 bp, Homo sapiens
  misc_feature 451: n = A,T,C or G
gacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagngtacttcacactactagatggtaaaactatatgattattggcatatactgactgactgc

SEQ ID NO: 51544 - DNA, 575 bp, Homo sapiens
  misc_feature 24, 25, 375, 395, 463, 484: n = A,T,C or G
gatgaacagtgtgtggttggcaanntttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgnacatttttaatactcattgncaatttgagaaaaaggacatatgagtttttgcatttattaatgaaacttcctttgaaaactgctttgnattatgatctctgatcattgncatttttactaccaaatattaactaaggccttattaatttttatataaattataatcttggcctattaaaatctagtacaatctaaaaaaa

SEQ ID NO: 51545 - DNA, 271 bp, Homo sapiens
  misc_feature 24, 46, 53, 99, 130, 139: n = A,T,C or G
cccagccagtttggtgctgacggngagaggaaattagaatctgttngcaaatngtccaacccaccccctcaacatgaggggcttccattttctgggttntgtaagggaactgtttccttcatgccgccanggtcctganattagttctgatttctttttaacaaatgttatcatgattaagaaaatttccagcactttaatggccaattaactgagaatgtaagaaaattgatgctgtacaaggcaaataaagctgtttattaaccttggg

SEQ ID NO: 51546 - DNA, 110 bp, Homo sapiens
  misc_feature 107: n = A,T,C or G
ggtaggcctttgtaaaattgacccagaggggaaaccccgtaaagtggttggttgcaagttgtgtagtagttaaggactatggcaaggagtctcaggccaaggatgtnttt

SEQ ID NO: 51547 - DNA, 124 bp, Homo sapiens
gatactggaaacctaactgcaatgtggatgttttacccacatgacttattatgcataaagccaaatttccagtttaagtaattgcctacaataaaaagaaattttgcctgccaaaaaaaaaaaa

SEQ ID NO: 51548 - DNA, 208 bp, Homo sapiens
gcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttgaaaaaaaaaaaaaaaaaaaa

SEQ ID NO: 51549 - DNA, 133 bp, Homo sapiens
  misc_feature 20: n = A,T,C or G
aaaggtccaggttcacactnccaaggccaaaacttccgcaaacatctgatgatgaaaagaaagatttttgagactgcagcctattaataaagttaacataactgagaaaaaaaaaaaaaaaaaaaaaaaaaaa

SEQ ID NO: 51550 - DNA, 420 bp, Homo sapiens
  misc_feature 276: n = A,T,C or G
aaaaccttgaaaactattacctgccggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgnttattacttccatgaattttaaaatctgagggaaatgttttgtaaacatttattttttttaaagaaaagatgaaaggcaggcctatttcatcacaagaacacacacatatacacgaatagacatcaaactcaatgctttatttg

SEQ ID NO: 51551 - DNA, 600 bp, Homo sapiens
  misc_feature 71, 119, 150, 236, 326, 334, 454, 485, 495, 543, 559, 577,580: n = A,T,C or G
ggctctgaagctcaagtcagaggagtgggaggtctgatcattgttgggggaaaaacgtaaggttattttgngtttttaagttggttttacaattctttcctggggaaattatttctggnggggaaaaagatccattctacgtatccttgnggagaaaagctaaataacctttaagaatgtgggtggtattggagaaagaagatgaattatagctccggagaatcaagatcttaagngaagcctttctgttcagatgtgatctataaaaaatcataatttggggaaagtttaagcaaatctggctttgtagtcctgatgttataagngactttgngatcaaactgtcaggcttgggttcttgttatagaatgcttggatagaaaaaccatgccatcattaatggctaacaacacgtagggacttcatggcatgtcaaagatagctctttgcaagngccttgattaaaccagaaaactgtcatcggntaacccaaanatctgaatgggcatctgggacctcatggggtttttggcctcataagangggccactctgtacanaggcattcctcctgcaanaangtggatctttgagaccggtg

SEQ ID NO: 51552 - DNA, 500 bp, Homo sapiens
  misc_feature 21, 44, 115, 395, 407: n = A,T,C or G
acatggcgcagtctattattntcacggagctgaatctgccgcanctagaaatgctcaagaaccagctggaccaggaagtggagttcttgtccacgtccattgctcagctcaaagnggtacaggaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgncatggaaatggngagtcagaagattcagcagctcacagcccttgggggcagctaaggctactgctaaggcctgagagttttttgcagaaatggggcagagggaca

SEQ ID NO: 51553 - DNA, 281 bp, Homo sapiens
  misc_feature 1, 149: n = A,T,C or G
naaagcataaaaagcaaggattaaaccttgacctttggcatcatgatttagccaacaccactaagcaaagagacctttagtttaaagccccgaatccaggtgagctaccccgagacagcctatttaacttagggccaacccgtctctgnggcaatagagtgggaagagctccgggtagaagtgacagacctatcgaacctggcaatagctggttgtctgggagatgaataaaagttcagcttcgtacaccccaaattaaaaaattaaatttaatttaacac

SEQ ID NO: 51554 - DNA, 250 bp, Homo sapiens
  misc_feature 57, 125, 128, 157: n = A,T,C or G
tttcttactacctaacgcccaagaaaaccaactaaggactctcgaaccatacctggngggggttcttcgctcaacctcttcttccctaggtcaaagccactatcatctgatgtgttagggatggnttntgattggcagaaattaatcagctcccaangggagcccacggaactaagtagggtcccaagaaaaaaaacgggagctatttcacagagctgagcttctgccaaatttcattcctcaaaccttt

SEQ ID NO: 51555 - DNA, 390 bp, Homo sapiens
  misc_feature 45, 46, 50: n = A,T,C or G
ggtttgccttaaaggcttttaattttgttttgtttgcaaacatgnnttcnattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttctttttttttaactgagttgaattgagattgatgtgtttagactggatttttatctctctcaacttcctgcacttaacaatatgaaatagaaacttttgtctttactgagatgaggatatgtttgag

SEQ ID NO: 51556 - DNA, 398 bp, Homo sapiens
  misc_feature 29, 189: n = A,T,C or G
ttgttgcggaatacaaaatcaacatacanaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgntgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaa

SEQ ID NO: 51557 - DNA, 500 bp, Homo sapiens
  misc_feature 19, 21, 55, 106, 136, 162, 256, 283, 287, 372, 409, 433, 467: n = A,T,C or G
aaatatttaggaggcttgnanctacctgcattgtagaaccttttcttatctcagnggaaccttctataacctaaatataccattgatgattcttcttccattcagngacatccacagattatgcagctatacttgngaaatcgtgcatgaggccccagggcnccgttctagaacaacgtcacttcacacaggcagctgagaaaggttctcttgcttttccagtatcttcctaaggatggagcccaaaattgcaganaagtaacttttggaataaaaccagggngggnataaaacttcttattcttaaatttacatataagatctattaagcttgacacatctgggcatcacgcactgaagacaggaagcagntcactgagtcagctggttcccaagctcgccagaaggngataaggtactatcaaatgccagngagaatcttcttatagaataacctgggcccaagngattttaggacaaaacttgcccttctttggtta

SEQ ID NO: 51558 - DNA, 371 bp, Homo sapiens
  misc_feature 24, 87: n = A,T,C or G
gggagccctttggagaacgcccgnctcccaggccccctgcatctatcgagtttgcaatgtcacaacctctctgatcttgtgctcagnatgattctttaatagaagttttattttttcgtgcactctgctaatcatgtgggtgagccagtggaacagcgggagacctgtgctagttttacaggattgcctcctaatgacgcggctcaaaaggaaaccaagtggtcaggagttgtttctgacccactgatctctactaccacaaggaaaatagtttaggagaaaccaacttttactgtttttgaaaaattacagcttcaccctgtcaagttaacaaggaatgcctgtgccaataaaaggtttctccaaaaaaa

SEQ ID NO: 51559 - DNA, 265 bp, Homo sapiens
  misc_feature 24, 50: n = A,T,C or G
aatctaaattaaaaaagaaagaantttgaaaaaactttctctttgccatntcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaacca

SEQ ID NO: 51560 - DNA, 327 bp, Homo sapiens
gattagggagcctggagtccaatagtacctgggccctgtttcttaccagctttgtgaccccgagtaagccacctgatttccttgagcctcagttttctcatctgtgaaatagggataatcataaaccctgccccacagggctgttgggaggtgaacggaaatggtgcctacctattgccagtaagaagtggcagtggctgggcgtggtggctcacgcctgtaatcccagcactttgggaggccgaggcaggcagatcatgaggtcaggagatcgagaccatcctggctaacatgatgaaacccccgtctctactaaaaaaaaaaaaa

SEQ ID NO: 51561 - DNA, 303 bp, Homo sapiens
ttggtggagacttggatgtcatatcttctttgttttgggttttcttccctagtttattttgtggcttttaaagaagtggattgtattgtgagatcctgtgattcctggtggccagtatcctggattcctctaagatcttgcctctttcctcctcatgaaagcagcacacattgtgttaaccttatgtctcttgttaaatgagcttaatgtctttgtgttttgtccaaaactgtattgaaaaaatattgtttaatgcaaatgagggaatgcaataaagagtaaatatactccaaaaaaaaaaaa

SEQ ID NO: 51562 - DNA, 162 bp, Homo sapiens
  misc_feature 25: n = A,T,C or G
atttctaacagatgccagaatgctngtttatgggattgctgtgtttccttttaattatttgtggttccaaacaattattgtttgaacttttttaattctgtactaaaatctataataaagcttttccacagctttaaaactaaaaaaaaaaaaaaaaaaaaa

SEQ ID NO: 51563 - DNA, 377 bp, Homo sapiens
  misc_feature 22: n = A,T,C or G
gggaaaaactagtccaaaatgnacacggaccacaccgggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccacctgtggatttttcgcaagaacattaataaactaaaaacttc

SEQ ID NO: 51564 - DNA, 440 bp, Homo sapiens
  misc_feature 105, 348, 414, 430: n = A,T,C or G
gcaccccttcctgttcccaggatgccttggtgccaaaggaccccacccctctgctggtcctgccaacgtgttggtgctataagctgcttcagatataaaattggnttatctataatgtttgttcatttaatagcttctaaaaggcctttttgttatacagtgctttttttctagttttatggacttgattactgtaataatgtcttggttttagccatgtaactacaaacagatattctcttgatgtcttagtaaatttgcatttgatatatcattgatgagattttgttgttatgtaatattctttggctacgcatctgtccagcatcttattaaccataatactgngatcattatttggaaatatgtcctatggaaagaataaaagcatgtacttcacagctagcatgttcncagatttgaaagaggnttcattaaaa

SEQ ID NO: 51565 - DNA, 310 bp, Homo sapiens
aggctttttatgagtaacacacaccatatataaaacagacctttcctggctgaccacatggttaaatgcataccttcccagtactggggggaaaaaatgacccttcttagaatgtgcaagttccatgagagtaatatattgatatgattttgaaaagaattgttgatagttacatcttcaaacttatcattccagtatgcatctttaagataatgtgattctaagtagatgactttatattcttgattaaagagtgctatacatgttaagaaatgcattaaggaatacaataaatattctaaagtgatgt

SEQ ID NO: 51566 - DNA, 500 bp, Homo sapiens
  misc_feature 17: n = A,T,C or G
ttatggccgggaagcgncaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgccgtcatttaaagcctagttaacgcatttactaaacgcagacgaaaatggaaagattaattgggagtggtaggatgaaacaatttggagaagatagaagtttgaagtggaaaactggaagacagaa

SEQ ID NO: 51567 - DNA, 400 bp, Homo sapiens
  misc_feature 16, 41: n = A,T,C or G
tatggccggggaggcnttgaggcagccagcgcaggggcttntgctgagggggcaggcggagcttgaggaaaccgcagataagtttttttctctttgaaagatagagattaattgggagtggtaggatgaaacaatttggagaagatagaagtttgaagtggaaaactggaagacagaagtacgggaaggcgaagaaaagaatagagaagatagggaaattaggaagataaaaacatacttttagaagaaaaaagataaatttaaacctgaaaagtaggaagcagaagagaaaagacaagctaggaaacaaaaagctaagggcaaaatgtacaaacttagaagaaaattggaagataggaaacaagatagaaaatgaaaatattgtcaagagtttcagata

SEQ ID NO: 51568 - DNA, 170 bp, Homo sapiens
ggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaaaaaaaaa

SEQ ID NO: 51569 - DNA, 400 bp, Homo sapiens
  misc_feature 387: n = A,T,C or G
cgtcaagtgactgaggcctgtggtggagaaggacgtgccgtgctgctgggttctgagccggagtggtcggtgggtgggatggaggcgaccttagagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcatanggaactggatcct

SEQ ID NO: 51570 - DNA, 400 bp, Homo sapiens
  misc_feature 23, 178: n = A,T,C or G
aggcccaatccaagaaaattganccgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgntaagaaataggccaagtgcggtggctcacgcctataatcctatcactttgggaggcctaggcaggcagatcacctgaggtcaggagttcaagaccagcctggccaacatgaggaaaccccatctctactaaaaagacaaaaaaattagctgggcatggtggcatatacctgtaaccccaactacttgggtggctgaggcaggagaattgtttgaacctggga

SEQ ID NO: 51571 - DNA, 500 bp, Homo sapiens
  misc_feature 24: n = A,T,C or G
tggcagttccctttggatttgttntgctctgggctcatgaagatattgcatcgtgagctgcagcagttgcactctttttcaatgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccaccctcggttactctgacataggaattta

SEQ ID NO: 51572 - DNA, 308 bp, Homo sapiens
  misc_feature 50: n = A,T,C or G
ttatggccgggagctcggattaaatacatatggatgttacttctcttgcnccaaattatcttgatacattcaaatttgtctggttaaaaaataggtggtagatactgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaaaaaaa

SEQ ID NO: 51573 - DNA, 137 bp, Homo sapiens
  misc_feature 1, 26: n = A,T,C or G
naccaaacgagctacctaaaaacaantttatgaatcaactcgtctatgtggcaaaatagtgagaagatttttaggtagaggtgaaaagcctaacgagcttggtgatagctggttacccaaaaaaaaaaaaaaaaaaa

SEQ ID NO: 51574 - DNA, 410 bp, Homo sapiens
  misc_feature 398: n = A,T,C or G
aagcaagaaaccacagtgtctctcccactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtaggttttgtaaacactatagcatctgttaagatccagtgtccatggaaacattcccacatgccgngactctggacta

SEQ ID NO: 51575 - DNA, 188 bp, Homo sapiens
  misc_feature 25: n = A,T,C or G
aaagaaaaaaaggtttttgggaacnaatgaacttataaaggggttttatataaaacatcaattgtcttgtatattttggataagcagcagtaccagctttcatttgtaacagtctgtggcattggaaaaaaaggagtctgtgattgttgaagtgaattatgttttaaaaaaaaaaaaaaaaaaaaaaa

SEQ ID NO: 51576 - DNA, 310 bp, Homo sapiens
  misc_feature 12, 305: n = A,T,C or G
gcagttactagnaagaaaaaacagcatgaaggatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaagggtaatgtaaagaatgaagacaaagatcaaaaatccaaggagaatggtgccagtgtatgataaaatccatgtngtgat

SEQ ID NO: 51577 - DNA, 430 bp, Homo sapiens
  misc_feature 21, 26, 115, 176, 180, 184: n = A,T,C or G
ggaaactgttgaggaacaggntcgcnccactgagagagtgtttcaggatagacaatatcagattgatgctgctatcgtcagaataatgaagatgagaaagactcttggtcataantcttctagtttctgaattatataatcagctgaaatttccagtaaagcctggagatttgaanaggngganttgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctccctgggtcatctttcacaaggctcaaggacttcaaccctg

SEQ ID NO: 51578 - DNA, 400 bp, Homo sapiens
  misc_feature 25, 51, 204: n = A,T,C or G
tttaaaatctgagggaaatgttttntaaacatttattttttttaaagaaangatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagntttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgc

SEQ ID NO: 51579 - DNA, 450 bp, Homo sapiens
  misc_feature 56: n = A,T,C or G
agtcggagtgaaaagaaggcacggaaggctatgtccaaactgggtcttcggcaggntacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaatccaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatgga

SEQ ID NO: 51580 - DNA, 400 bp, Homo sapiens
cgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaa

SEQ ID NO: 51581 - DNA, 500 bp, Homo sapiens
ttatggccgggatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcacctacaattaaaa

SEQ ID NO: 51582 - DNA, 220 bp, Homo sapiens
  misc_feature 23: n = A,T,C or G
aatcggaaagagaaaaggggggngccggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgag

SEQ ID NO: 51583 - DNA, 490 bp, Homo sapiens
  misc_feature 42, 45: n = A,T,C or G
ttcctgagctgacagcattcggtccgagatgtctcgctccgnggncttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacctacacttta

SEQ ID NO: 51584 - DNA, 450 bp, Homo sapiens
  misc_feature 366: n = A,T,C or G
caaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggngatatgatcttaagcttttgtgtcagattatttaatatgatgacttcatgctttattatgccttattatggctgacgtattact

SEQ ID NO: 51585 - DNA, 500 bp, Homo sapiens
ggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgactttttttcccttagagatactatttactatctcctatcctgataggtggaagggttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcct

SEQ ID NO: 51586 - DNA, 435 bp, Homo sapiens
  misc_feature 206: n = A,T,C or G
tccggggacgttgtctgcaggcacttagtaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgnaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgcaaaaaaaa

SEQ ID NO: 51587 - DNA, 168 bp, Homo sapiens
  misc_feature 21, 58, 65: n = A,T,C or G
caagtcagggaaactaagganctgtctgtttagtggatacccgtgtattccctttaanaagaccnaggtaacagttcgtgttagtttaagactacttgttttgtacctgtactttcttgggtggcagaggaaagaaaagtaaaacattaaaaaaaaaaaaaaaaaaaa

SEQ ID NO: 51588 - DNA, 320 bp, Homo sapiens
  misc_feature 286: n = A,T,C or G
atatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgnaaatgaagatctttatatttcaataaatgatata

SEQ ID NO: 51589 - DNA, 280 bp, Homo sapiens
  misc_feature 180, 267: n = A,T,C or G
acgtggatcccatcgagctggttgtcttcttgcctgccctgtgtcgtaaaatgggggtcccttactgcattatcaagggaaaggcaagactgggacgtctagtccacaaggaagacctgcaccactgtcgccttcacacaggtgaacttcggaagacaaaggcgctttggctaagctggnggaagcctatcaggaccaattacaatgacaggatacgatgagatccgccgtcactggggtgggcaatgtcctgggtcctaagtctgnggctcgtatcgcc

SEQ ID NO: 51590 - DNA, 430 bp, Homo sapiens
  misc_feature 52, 366: n = A,T,C or G
gtaaaatcattccttctgtttactcttttaattttcatcctttgcaggtagngcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgtgcaaaacacccagagacggcacaaggaggttgaactcatgtttcagttcgcgaacattgactccttacgaaagtcacttcattctaactagatgcgcccacttccggtcattattttcgtttgcatgatgtattgcttcttcacgttttgnttttattgagcacggagtagaattccagggctgccttgacttcttccctgcatgctccctccca

SEQ ID NO: 51591 - DNA, 289 bp, Homo sapiens
tttgcttgagcttcacctttaagggtctgatgataaacctgtgacttgcctgcctgcctgcctgatttttgtcaaaaggcaaaggtggtacaaaaatgtgttgtaggccaccttcgtaattctctgcacgaaatctctcaatcagatttaagcagacttcattatattacatttcattatatcagaatatcttctattttttacagtcatagctgtttggaaagggacaagtaatcgttaacatttaaaaataaaagatttggaaaaaaaaaaaaaaaaaaaaaaaaaa

SEQ ID NO: 51592 - DNA, 400 bp, Homo sapiens
gaatctgggaggtgttgggcgcggacagtcgagatgtcagataaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttattttgtgttttttgtaacacaaaaagtaaatgttttga

SEQ ID NO: 51593 - DNA, 500 bp, Homo sapiens
  misc_feature 4, 31: n = A,T,C or G
ggcnttatggccgggatgatggaattcaagncattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatatttttatggggaatttctttctaatattttttcaggcattaacaaaggagacgggggctcagggagtaaaggaaggccagttgagcaaacagaagtgttcctctgcatttcaaaaccttctt

SEQ ID NO: 51594 - DNA, 236 bp, Homo sapiens
ttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcgcaattctgctaatgtcatttggaacttcaaaataaatattcttgtccc

SEQ ID NO: 51595 - DNA, 400 bp, Homo sapiens
  misc_feature 381: n = A,T,C or G
atgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactggggaagatggattcagatgaagacatgtctaattttgatcgtttctctgagatgatgaacaacatgggtggtgatgaggatgtagatttacccagaagtagatgggagcagatgatgattcacaagacagngatgatgaaaaaatgccag

SEQ ID NO: 51596 - DNA, 235 bp, Homo sapiens
tcaatatttagtaaagctttttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaaaaaaaaaaaaaaaaaaa

SEQ ID NO: 51597 - DNA, 230 bp, Homo sapiens
tggaaataactgaaaagagtacacgagtaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccgaaaaacaaaaaaaaaaaaa

SEQ ID NO: 51598 - DNA, 430 bp, Homo sapiens
ggacaactcggtggtggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccgcgcctgcctttcccatctgtctatctatctggctggagggaaggaaagaact

SEQ ID NO: 51599 - DNA, 360 bp, Homo sapiens
aatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagaccatagattggacctggtttttgttttcctgcagctgatgacttgttgcctgaagtacaataaaaaaaattcattttgctccagtaaaaaaaaaaaaa

SEQ ID NO: 51600 - DNA, 424 bp, Homo sapiens
  misc_feature 20, 387: n = A,T,C or G
ggagggctgagcttgcaagnaggatcaacatgcctttggctagagatttactacatccgtccttggaagaggaaaagaaaaaacataaaaagaaacgcctagtacaaagtccaaattcttactttatggatgtaaaatgtccaggttgctacaaggatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattcantttgggtttgtaaggtatacagcagtaatctcctatt

SEQ ID NO: 51601 - DNA, 340 bp, Homo sapiens
aacagctaaggactgcaaaaccccactccgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttacctcacccccaagaaaaaaaaaaaaaaaaaa

SEQ ID NO: 51602 - DNA, 240 bp, Homo sapiens
cataaggtttttagcacgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaaggaatgacttagaaactgtgaaaaaaaaaaa

SEQ ID NO: 51603 - DNA, 400 bp, Homo sapiens
  misc_feature 23: n = A,T,C or G
actgtgggcgacataaatacagnaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtaggtttttatctgaaatcaattaaaagtgtatttgttactttaaaaaaaaaaaaaaaaa

SEQ ID NO: 51604 - DNA, 480 bp, Homo sapiens
  misc_feature 391, 397, 448: n = A,T,C or G
atttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcaccgggggcaagtgacagccctggtttctctgaaggctggactaattcaatcaagatcaactctaagtgatttccagggaaccttcatgactgttggaattgctctgtcataataagtcagggatattttaaggaggctcatagtctcctgggagggataaaacatctcggcacctagtaatggtaaattagtcaatatttgttaagnttccgnttgagatctcaaatgttaggattttcttgaagtctcagtgtctttcagagnttgagataccctttggtttcattctttctaat

SEQ ID NO: 51605 - DNA, 200 bp, Homo sapiens
tactaaaaatacaaaaattagctgggcgtggtggtgcgtgcctgtcatcccagcttctcaggaggttgaggcaggagaatcgcttgaacccagaaggcagaggttgcaatgagctgagattgtaccactgcactccatcctgggtgacagagcaagactgtctcaaaacaaaacaaaacaaaaaaaaaaaaaaaaaaaaa

SEQ ID NO: 51606 - DNA, 500 bp, Homo sapiens
  misc_feature 166, 210, 256, 283, 317, 334, 368, 391, 401, 455, 474: n = A,T,C or G
ggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctatnactgaaatgaatttcctttttctgaaatgcaatcattgatgctngaatgatagaattttagtactgtaaacaggctttagtcattaatgngagagacttagaaaaaatgcttagagnggactattaaatgtgcctaaatgaattttgcagnaactgggattcttgggntttcctacttaatacacagtaattcagaacttgnattctattatgagtttaagcagncttttggagngaccagcaactttggatggttgcactaagattttatttggaatgcaagagaggntgaaagaggattcagtagnacacatacaactaaatttatttgacc

SEQ ID NO: 51607 - DNA, 295 bp, Homo sapiens
  misc_feature 37: n = A,T,C or G
ttatggccgggattgtggggctcataaaacatgaatnaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtaagagcttagatttccctattgtgacagagccatggtgtgtttgtaataataaaaccaaagaaacaaaaaaaaaaaaaaaaa

SEQ ID NO: 51608 - DNA, 270 bp, Homo sapiens
  misc_feature 202, 207: n = A,T,C or G
gatgagagttttggatgcagtgctctgctgttgctgaataggcgatcacaacgtgcattgtgcttctttctttgggaatatttgaatcttgtctcgatgctcataacggatcagaaatacagattttgatagcaaagcgacgttagtcgtgagttcttgtgaggaaagtcattggctttatcctctttagagttagactgtnggggngggtataaaagatggggtctgtaaaatctttctttcttagaaatttatttcctagttctgtag

SEQ ID NO: 51609 - DNA, 400 bp, Homo sapiens
  misc_feature 293, 391: n = A,T,C or G
ttatggccgggatagtttaggaaaatattttctaagaccagttttagatgactcttattcctgtagtaatattcaatttgctgacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggngttttatatattagaagcaattataattacatctgtgatttctgaactaatggtgctaattcagagaaatggaaagtgaaagtgagattctctgttgncatcggcat

SEQ ID NO: 51610 - DNA, 410 bp, Homo sapiens
  misc_feature 292, 336, 383: n = A,T,C or G
aactcggtggtggccactgcgcagaaccagacttcgctcgtactcgtgcgcctcgcttcgcttttcctccgcagccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgcccgccaatatgcactgtacattccacaagcattgccttcttattttacttcttttagctgtttaacttntgtaagatgcaaaagaaggttggatcaaggtttaaatgaccggngctgcccctttcacatcaaagaactactgacaacgaaggccgcgccntgcctttccccatctgtctatctatct

SEQ ID NO: 51611 - DNA, 400 bp, Homo sapiens
  misc_feature 375: n = A,T,C or G
ttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattgggattgccacacggctcacattgcatgcaaggtttgctgagctgaaggaaaagattgatcgccgttctggtaaaaagctggnaagatggccctaaattcttgaagtc

SEQ ID NO: 51612 - DNA, 420 bp, Homo sapiens
  misc_feature 376: n = A,T,C or G
atagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatgggaggacctcaaaatggggttggtcacagcagatgtagctttttacactggaaatcttcaagccttaaaaggccttagagatttggacctaaatatggccgaaatttgggagcagaagagggngatgtcatcctggaaaactggggtagttcatctgaccatgggat

SEQ ID NO: 51613 - DNA, 400 bp, Homo sapiens
  misc_feature 144: n = A,T,C or G
taggagcctctctccctactgctgctacacaagtaccctgagtactgacctgcaggacgaaaccatgaagagcctgatccttcttgccatcctggccgccttagcggtagtaactttgtgttatgaatcacatgaaagcatggnatcttatgaacttaatcccttcattaacaggagaaatgcaaataccttcatatcccctcagcagagatggagagctaaagtccaagagagggatccgagaacgctctaagccctgtccacgagctcaataggggaagcctgtgatgactacagactttgcgaacgctacgccattggtttatgggatacaatgctgcctataatcgctacttcaggaagcgccgagggaccaaatgagactgagggaagaaaaaaa

SEQ ID NO: 51614 - DNA, 394 bp, Homo sapiens
cgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatggataaatggatctgtgagatgc

SEQ ID NO: 51615 - DNA, 400 bp, Homo sapiens
  misc_feature 362: n = A,T,C or G
cggggaaggcagcaaaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagcctgacctgacacagattgatgtcaatgtccaggatcatttctgggatgggaagggatgtgagatgatctgntactgcaacttcagcgaattgctctgcttgcccaaaag

SEQ ID NO: 51616 - DNA, 170 bp, Homo sapiens
atatactataaaacctaaatgatcgaggccgggcgcggtggctcacgcctgtaatcccagcactgtgggaggccgaggtgggcggatcacgaggtcaggagatcgagaccatcctggctaacatggtgaaaccccgtctctaccaaaaaaaaaaaaaaaaaaaaaaaaaa

SEQ ID NO: 51617 - DNA, 500 bp, Homo sapiens
  misc_feature 498: n = A,T,C or G
gaaggtaggaggtcctgggtgactttggaagtccgtagtgtctcattgcagataatttttagcttagggcctggtggctaggtcggttctctcctttccagtcggagacctctgccgcaaacatgctccgccagatcatcggtcgggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttgggagatctctattgnaa

SEQ ID NO: 51618 - DNA, 460 bp, Homo sapiens
atattcacagtgaacataactgtaacatatatgaaaggcttctgggacttgaaatcaaatgtttgggaatggtgcccttggaggcaacctcccattttagatgtttaagggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttagggtgggagatgacagaata

SEQ ID NO: 51619 - DNA, 227 bp, Homo sapiens
  misc_feature 26: n = A,T,C or G
gccataatatttcgcccactaagtcnaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcccaaaaaaaaacaaaaaaaaaaaaaa

SEQ ID NO: 51620 - DNA, 440 bp, Homo sapiens
  misc_feature 182, 302: n = A,T,C or G
acaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcatttggntgttcaataagtgagatgattacagataacttaatactgtattttccttatatggaaaaccggtatagacccaataacaactaaacctttcaaaagaaaatattttctattatgaatggnttgattttcataccaaagaagatgggagagtctaaaatttgggatatgattccttatgggtttttttaataagaaaaccttcttcaaggtttatttttcctaaataaacatcataattggggaattttctctaggatt

SEQ ID NO: 51621 - DNA, 477 bp, Homo sapiens
  misc_feature 377, 465: n = A,T,C or G
atcttgccttgattaaggcaaagcaaaaccccagtccgcccctctgatggactgagcacaccaaatttctaaagcacaggcaaattagaaaatataattttgtctaaacttgccaacaagctaaggttttgtgaaccacctaaaatttgcctctctcatactgaaattttctaggtcaagtatctgaaggaatacactactgccagtattttcttttggtgatctgtcatatacagcagacattacttgaaacaaagaaaaaaatgttttaaaacctgtctggatgatttccgcagtctcactaggttattgcagccagggagtgaccctagcagagatctggaaggtgagcttccctagtactggcatctcacagngaaagagcactgttcagtgggtcaagagacccagagcctactctcagttacgacacacatagtccttgtgtggcctttctgggcttgngtcctgaactat

SEQ ID NO: 51622 - DNA, 540 bp, Homo sapiens
  misc_feature 403, 458: n = A,T,C or G
aggaatggaaataaaattgggatgagccctaatggaggaagtcgggcaaattgaaagtataaatgaatgggccatgagtgttcagagggagaaaagaaaggtttaatatactccttcagttgagttttcttgtcttgaatataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggnatgctcgcagcattagcaaaattaggagtttcatctttttcattgaatcacaggnggagactcctattttcctttctgttttcaggcctttgagcccctgggagcccaaataccactcaattattttgtatttatga

SEQ ID NO: 51623 - DNA, 317 bp, Homo sapiens
ttgaccgggagaaaacgagatgggggtgaagctggagatatttcggatgataatctacctcactttccctgtggctatgttctgggtttccagtcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttaaaaaaaaaaaaa

SEQ ID NO: 51624 - DNA, 310 bp, Homo sapiens
  misc_feature 175: n = A,T,C or G
gaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcnaaatgtacaaacttagaagaaaattggaagatagaaacaagatagaaaatgaaaatattgtcaagagtttcagatagaaaatgaaaaacaagcgaagaaaagaatagagaagatagggaaattagaagataaaaa

SEQ ID NO: 51625 - DNA, 440 bp, Homo sapiens
  misc_feature 157: n = A,T,C or G
attttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggngttctttgttccttttcataagctaataccactgtagggattttgttttgaacgcatattgacagcacgctttacttagtagccggttcccatttgccatacaatgtaggttctgcttaatgtaacttattttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgc

SEQ ID NO: 51626 - DNA, 110 bp, Homo sapiens
  misc_feature 7: n = A,T,C or G
ggctgtncatttcttacagggctctaatggatgtttgaactttgttgcctggaggggccaaccagccagggtttcacctttacacctggttccttggtaaaatgggctgc

SEQ ID NO: 51627 - DNA, 361 bp, Homo sapiens
tggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatctttggtgggcacgagcaagcacgtcgcgtttggaaaaattatctcccagcaatt

SEQ ID NO: 51628 - DNA, 236 bp, Homo sapiens
caagtcttttctgtactgttcttgtgatagtgaataagtctcatgagatctgatggttttaaaaagaggagtttccctgctcaagctctctctctttgcctgctgccatccatgtaagatgtgacttgctcctccttgccatctgccatgatgtgaggcttccccagccacgtggaactgtaagtccaattaaacctcttttctttgtaaaccaaaaaaaaaaaaaaaaaaaaaaa

SEQ ID NO: 51629 - DNA, 400 bp, Homo sapiens
ccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatccccagaagaaactgaagaaacaaaaacttatggcaccgggagtaaaattcagcattaaaata

SEQ ID NO: 51630 - DNA, 220 bp, Homo sapiens
tcatatgcttcttgcaatgcatattttttaatctcaaacgcttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgagtgaaaaaaaaaaaaaaaaaaaaaaaaaa

SEQ ID NO: 51631 - DNA, 420 bp, Homo sapiens
  misc_feature 324, 387: n = A,T,C or G
cagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttttgggnttgacactgtattttttcacattgatttactgggttgatgatagattttataacctaaccggntctcatgcggtgcgtaattgtagatgcatgtac

SEQ ID NO: 51632 - DNA, 459 bp, Homo sapiens
  misc_feature 112, 388: n = A,T,C or G
tcctttgcagtcggagacctctgccgaaacatgttccgccagatcatcggtcaggccaagaagcatccgagcttgatccccctctttgtatttattggaactggagctactnggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcantgttgggagatctctattgtaatctctattgggagattacaatgattaaatcaataaataactgaaacttg

SEQ ID NO: 51633 - DNA, 500 bp, Homo sapiens
  misc_feature 5, 261: n = A,T,C or G
agagngtgaagtaggcaattgcgaattgtctgtcacatgccaggattatctagcaggctagcaaattttattgaatatatcattttacattttttataggtatgtgttgtttcatagtacagttcttcaggtggcaaaaaaaaagtttattaacatacccaaacgtatatagcctctctgtaccatataaaaataagtagccaaaattatataaacttaagcttagtaattaatggtttcagtagtttatttagaaatggnctagtaattaatatctattgcttaatttagcataggtctaatgttgcaaattacaaaaaattttggaaacaattattaagtcagatattataaaacataattattattggaaatgtccatttataaaacttttattccacttaaattaatacacatgttcttaacacatatgcttggattgtttatcaaaatttcacaatacactagacaaagctagccatcatctcaaggtatttccc

SEQ ID NO: 51634 - DNA, 207 bp, Homo sapiens
  misc_feature 41, 42, 70: n = A,T,C or G
gtccgagtggtggtggaagggaagccctgtagtccccagcnncttcaggaggcttgaggcaaagaagaantcacactgaaccctgggaggcagaggtttgcagtaagcccatgatgaaattaaagccacttgcacttcttagccctgagcaacagagcaagacttctgtctcaaaaataaataaataaataaaaaaaaaaaaaaaaa

SEQ ID NO: 51635 - DNA, 400 bp, Homo sapiens
  misc_feature 34: n = A,T,C or G
atatgaaagtgatatggcaagcgggaagacgagngttcttgtttgagagacctaatggagtgataaggctccagttctgtgtatatgtgggatgagaaagaatggataggttgtaggagctagaaagtggcagaaagattgcaaaggtagtaatagccattatttgagtgcttgctctgtgccaagcacttttctaagtgtattatctcatttactgctagtgaggaaactgaatttagtttgcttaaggtcatgcaggtagtaagcagtggagctgtagtctgaatccctgcttaatgttatttaagagcttttgctgttaacagttaatattttacagccttagaagagccttatatatcatgctaaagattttgaacttaatcttgttggcattggg

SEQ ID NO: 51636 - DNA, 272 bp, Homo sapiens
ggcgacaaacctaccgagcctggtgatagctggttgtccaagatagaaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaaaaaaaaaaaaaaaaaaaa

SEQ ID NO: 51637 - DNA, 424 bp, Homo sapiens
  misc_feature 27, 43: n = A,T,C or G
ttggtgttgaggttagcactaccgtantcaaggacagtaaccnacccctggcttcccgaagttttgccaaaacctcggatgcgtggcctttctggccaggcgtctgcgaaaatcttatggctgtagcattcgtgctatccctgggggttgcagctttgtataagtttcgtgtggctgatcaaagaaagaaggcatacgcagatttctacagaaactacgatgtcatgaaagattttgagggagatgaggaaggctggtatctttcagagtgtaaagtaatcttggaatataaagaatttcttcaggttgaattaccttagaagtttgtcactgacttgtgttcctgaactatgacacatgaatatgtgggctaagaaatagttcctcttgataaataaacaattaacaaattaaaaaaaaaaaa

SEQ ID NO: 51638 - DNA, 318 bp, Homo sapiens
tactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctctgaatagtgatgtgttcgacgttttatcaaaggccccctttctatgttcatgttagttttgctccttctgtgtttttttctgaaccatatccatgttgctgacttttccaaataaaggttttcactcctcaaaaaaaaaaaaaaaaaaaaaaaa

SEQ ID NO: 51639 - DNA, 366 bp, Homo sapiens
ctgctctcagggccctcaatcttgtactcggtctatttggaaaaggatttaaagggcaaagaaaataatatcttcatctactattcgggcttttccaggacaatactgatttcaaatattttatcctcctgtcgccttaagctatcacaaatgttttagaaatcccaactttcgtagtgtctaaatgggaattttcagaattgcctgtaaacctcttaccttctgcagcacaaaaacctttctctgaacacacatctcagatttttggctgggataatacagtcatcatagaatactgaacagaaggaatttcaaaggaaggcaatttaaagttagaggggaaagagcagtaaatgtaaaactatt

SEQ ID NO: 51640 - DNA, 336 bp, Homo sapiens
gagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 51641 - DNA, 550 bp, Homo sapiens
  misc_feature 10, 24, 26, 33, 52, 71: n = A,T,C or G
tttttttatnccgactaactatgngnttatggngcgggcactaaaggatttnctgtgctgttacactaccnaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagacttcaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaat

SEQ ID NO: 51642 - DNA, 310 bp, Homo sapiens
  misc_feature 93, 179, 200, 246, 285, 308: n = A,T,C or G
gccctgttctgcttcgaagtattcaataccgctcagtattttaaatgaagtgattctaagatttggtttgggatcaataggaaagcatatgcngccaaccaagatgcaaatgttttgaaatgatatgaccaaaattttaagtaggaaagtcacccaaacacttctgctttcacttaagnggctggcccgcgattactgtnggaacaagcatgatcttgttactgtgatattttaaatatccacagnactcactttttccaaatgatcctagtaattgcctagaantatctttctcttacctgttattnat

SEQ ID NO: 51643 - DNA, 300 bp, Homo sapiens
  misc_feature 23, 174, 284: n = A,T,C or G
aaaaataccttccaaatttgccnagaaaaaaaattctattttaaacttgtatcctgagtctgtttcattcaacatgagatgtgtgatgactgccatcctgaagatctgaagccaaaccatgtgcctcagtcttgagtggaagaatcacctttatggtttgtggaaatcatggcncaattaaaataagttgggagggacaacggtgacaaaatttgagttagagacattcattttgaaaagcaccttagtaaagttatttcctctgatgttgtaatgggggcagngggggtaacgcacatt

SEQ ID NO: 51644 - DNA, 240 bp, Homo sapiens
  misc_feature 212, 227: n = A,T,C or G
attgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactactgtgcaacttttcccaatgnggcctaaaaatgcancttctttttattt

SEQ ID NO: 51645 - DNA, 268 bp, Homo sapiens
caaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 51646 - DNA, 230 bp, Homo sapiens
  misc_feature 108, 166, 168, 185, 204, 227: n = A,T,C or G
taagaaggatctggggcttgccccccatgagaatactcctaaaaaaaaaatgaaatgataccctttaaacagaattaagaggcaaatattagagctctccctaaatgntcctattaatggcatattaattaaacctagagaaaagggcaggcaaaatttagaaagngngaatgaatcattcaagntcgccttggggttagttgnggatcaactctcttcattaaaangcc

SEQ ID NO: 51647 - DNA, 300 bp, Homo sapiens
  misc_feature 22, 23, 275: n = A,T,C or G
actgtgatgactgggagagcgnnctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccaccgtgaccaacttgcgcaagatgggagcgcccgaatctggcttggcggaatatctctttgacaagcacaccctgggagacagtgatantgaaagctaagcctcgggctaattt

SEQ ID NO: 51648 - DNA, 150 bp, Homo sapiens
  misc_feature 91, 138, 146: n = A,T,C or G
actaacgtgtgacggggaagagctccctgctgtgtgcctgccccaccccactgccttccttcagtacctttagctgcatttgtatgccagngcttaacacattgccttattcatactagcatgctcatgaccaacacntacacgtnatag

SEQ ID NO: 51649 - DNA, 300 bp, Homo sapiens
  misc_feature 26, 142, 179, 230, 283, 290: n = A,T,C or G
aagttaattgatattatactttgggnttatctaaaaagtaaatgtatttgcctttgacaaaagactgacacaagagcaaataagctttaaaatcgggtgttatgtgctttcctccatttttgagcatattatccaaaatggnctgtataatataaatgagaatgatgcagtttaaggangccttgttataccattgtcatgggacccctgtcataaagccatttcttggntttgtttggggaaagaggcatatgggatttatacagattcacttgtaaatgtnggattgnggattttttg

SEQ ID NO: 51650 - DNA, 300 bp, Homo sapiens
  misc_feature 23, 207, 286: n = A,T,C or G
tcatgaaagtagattgtcccagngtaaagctaaccaatgaaattttactacttcataaacattttgttcttttaattttcaaggaaaaaaatagggacctcttcaaaataatcaggatagtcagagtccctttttgtttggaaaaggtttcttgaaacataaaatctttgttggggtaagactttggattttaggccaagttacagntttcagcaatttcagacatctgctttatgatgttactgaaagccgttcccccaccacattaaacccaagctttttgggnttggacaggtgatg

SEQ ID NO: 51651 - DNA, 170 bp, Homo sapiens
acaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattc

SEQ ID NO: 51652 - DNA, 150 bp, Homo sapiens
  misc_feature 90, 129: n = A,T,C or G
gctaagccgccatcgtaaggtgctccgggataacatccagggcattacaaaaccggctattcgccgtttggctcggcgcggtggcgtcangccgcatttccggtcttatctatgaggagactcgagggngtgctttaaaggttttcttaa

SEQ ID NO: 51653 - DNA, 169 bp, Homo sapiens
gttaatatcgccccactccgcgccctgggacgatttcttcccgggttccgatcgctttgcccggccggacttcagggacatttccaaatggaacaaccgcgtagtgagcaaccctgctctattaccaggaccaactacctggtggtggcctgccattgatgatttccat

SEQ ID NO: 51654 - DNA, 200 bp, Homo sapiens
  misc_feature 24, 25, 39, 100, 121, 145, 163: n = A,T,C or G
ggtttcgaggggtcgagtgtaggnnaacagcctgttgcnttgtaagagtgatgtcatcttgaagagcagctggcatgatgactgctgtttgactcctgcntaccaagatattctgcagcantgtctttaaacagtgccggtggtncagataacccctcataangatgcttatctcacctccccagtgttcaggtgtttca

SEQ ID NO: 51655 - DNA, 260 bp, Homo sapiens
  misc_feature 45, 201, 212: n = A,T,C or G
gtgcattttatactgtattaaatatggagatacttctaatgcctntctaaaattaaattttacataaaagttagttttattcacctttaggctttccaagtgaattgtgactaattttttcaatcttacatagatctttcacccattagcattacttacgtagataattctttatgcctagttattatacatattaatttntaagggatacntttaaattacacaattgttcattgggggttgcatcccagaatgtggtg

SEQ ID NO: 51656 - DNA, 300 bp, Homo sapiens
  misc_feature 19, 24, 50, 251, 281: n = A,T,C or G
aaaaacataccaactgtgnatgantaccttgaaaactattacctggaggncaatcaacttgagaagtttgacataaagagcttctgcaagaatcctggggccattatcctactccaagatcaagcatttgcgtttggatggcaatcgcatctcagaaaccagtcttccaccgggtatgtatgaatgtctacgtgttgctaacgaagtcactccttaattaatatctgtatcctggaacaatattttatggntatgtttttctgggcggcagttttcatagnatccatattttattactgg

SEQ ID NO: 51657 - DNA, 143 bp, Homo sapiens
  misc_feature 24: n = A,T,C or G
ccgacttagaactggtgcggaccntgggaatccgactgtttaattaaaacaaagcatcgcgaaggccccgcggcgggtgttgacgcgatgtgatttctgcccagtgctctgaatgtcaaaaaaaaaaaaaaaaaaaaaaaaaa

SEQ ID NO: 51658 - DNA, 429 bp, Homo sapiens
  misc_feature 151, 155, 157, 291, 408: n = A,T,C or G
aagttgtgctggagtgggagccatgattaaaagaggcttaagtgttttataaataacctataaacaaattataaatacaatcaatttttttccttgcaaccatagcaaacactaaactgttctcagtaagtttgctttaaattatataggncagntnatcacaatgccattctaaaattcctgatttattaatggattcattcatttattcatcattatttattcatttattattttttcaagacagtcttgctttgttgcccaggctggagtaccgcaattggtgcaggncatagctcactgcaacccccaaactcctgggctccagtgatcttcccacgttagcctcccaaagtgctgggattacaggcctgagccaccatacccaggacctggtttatgcatggnttaataaaatatttgcaaagg

SEQ ID NO: 51659 - DNA, 207 bp, Homo sapiens
  misc_feature 53: n = A,T,C or G
atcctttgcctttacaataagtaatattctagttttctttattatatttttgncaaacaaaatcaaaaagtaaaattttaaaaatgagaatactttgtttgattctatgtaaataaatatgacaacctaaagaaaatatgcaactttttagagtaaattaattacaaaaatgaagaaaacattgaaaactaaaaaaaaaaaaaaaaa

SEQ ID NO: 51660 - DNA, 170 bp, Homo sapiens
  misc_feature 66, 125: n = A,T,C or G
agaagtcgtgccaatcagccctgtaaaggaaaggctcactatggactttctctattttaaaatggnaacaatcagaggaactataagaacacctttagaaataaaaatactgggatcaaactggnctgcgaaaccatagtcagggtaattctttttttcatccttcctct

SEQ ID NO: 51661 - DNA, 340 bp, Homo sapiens
  misc_feature 230, 313: n = A,T,C or G
atccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggntgaggagactggcaacctgaaaaaggctgtcattctacagggctctaatgatgttgaacttgttgctgagggcaacagcaggntcaccttacactgttcttgtagatggc

SEQ ID NO: 51662 - DNA, 430 bp, Homo sapiens
tgctgtttggattataattcttcttgcaaaacaatttagataccatgtcaagaaccataaaaatattcatactctttaagaatccgtctctaggagtttaccccagttaaaatgaagaaatattaaatgagttaaagaaaatatttttcagtagtgaggaagaatccatccatttattctttcatttcatttaaggagaccagtattatttgtgctaggctctgtcctaagcactggacatacacaaatgattaagataggattcccaccctgtcatagcttaaagtctaatggtgaagagaatgttaggggaagacagagaagaggaaagcctaaaatacacaatctcagttcagttaggacatgtaagaataacctaaaaatgttcagcaactgggaaatgtttcagaacattttgatatattggata

SEQ ID NO: 51663 - DNA, 360 bp, Homo sapiens
  misc_feature 181, 283, 321, 334: n = A,T,C or G
gggaggcgatcagcagataccatagggaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaacgngggattcttttgcatgatggggtaaagcttagcagagaatcatgggagctaacctttatcccacctttgacactaccctccaatcttgcaacactatcctgnttctcagaacagtttttaaatgccaatcataggagggngctgtaaaagtgnacaagttacctttatatatggtaaat

SEQ ID NO: 51664 - DNA, 126 bp, Homo sapiens
  misc_feature 23, 28, 49, 102: n = A,T,C or G
aggagagagaagcagcaattttngaagnagtgtgtgagagagaagttanctcaagccaaaatggccgacagagtctctgctggtttctgaatatttaaaatncaaaaaaaaaaaaaaaaaaaaaaa

SEQ ID NO: 51665 - DNA, 310 bp, Homo sapiens
  misc_feature 27, 105: n = A,T,C or G
aataaagctgcccagcctgggcctggnaaaggaaaagtacagtttcagggcaagaaaacgaaatttgctagtgatgatgaacatgatgaacatgatgaaaatggngcaacctggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtga

SEQ ID NO: 51666 - DNA, 110 bp, Homo sapiens
  misc_feature 25: n = A,T,C or G
agtatttagtaaaaaagtttacaanttaatctagtttacagaaaaatcttgcgctagaatactttttaaaaggtattttgaataccattaaaactgctttttttttttcc

SEQ ID NO: 51667 - DNA, 450 bp, Homo sapiens
  misc_feature 113, 183, 441: n = A,T,C or G
tgtcagacagctggagttcagtgagccagacttcgtggcaaagttttaccaagcagtggctgctacagctggtaaggactgataggcattcagaccaaagaagataaccatangctgatggagccatgactctctacaatgataactcaattcaaatgtgtcgcctaaagctctggaactggnattccaaccagctgaccgaactcactgaccagtacaggcatggttatttcaacattaatagcatgtcaactggactcctatttgtaaatgttatcaatctaagcaatccagctcatcagtctacctagtttgccttctttccgagagatgtcaagtccctcaagaattttgatggcttcttctgcagctataaccacaagggaacctacacattgtaacttcaagtcccacttgctggctcatgaaatgtgtaaaagnagaaccctt

SEQ ID NO: 51668 - DNA, 195 bp, Homo sapiens
accaagtttgtgtgatacaactaaagtagtgcttagaggaaaattcatataattatggacttatatcagaaagaataaagacctaaatttaattatctaagtttccttttcagagagctgcaaaaataagaggtaatttaaaccaaaggaaacagaggcaaggagtaatgaagataaggaaaaaaaaaaaaaaaa

SEQ ID NO: 51669 - DNA, 300 bp, Homo sapiens
  misc_feature 34, 40, 149, 150, 152, 183, 185, 258, 275: n = A,T,C or G
cttttcaaattttcatttttactccttacaactngaattnttccatcttttataaaatatattttttccatatctttctttaagctcctgctgtgagcggccatctcaaatcctatagagctgtgtaccctaaatataccatggggggnntnctatagatctcccagtgcattatgaattgangnctagataatctgttggggaaaaagtttcccctagggtaacttttgctttactactttatattctttccatctnagacatatttcctttanagggataaataggaaagctgcctat

SEQ ID NO: 51670 - DNA, 400 bp, Homo sapiens
  misc_feature 24, 204, 209, 234, 242, 261, 356: n = A,T,C or G
taaactgacatggctaactgcaantaattaaatcttctatccgagagtaataatttatgatgactcagtggtgccagagtaaagtttctaaaataacattcctctcacttgtaccccactaaaagtattaggactacacattacattgaagttaaacacaaaattatcagtgttttagaaacatgagtccggactgtgtaagtnaaagnacaaacattatttccaccataaagnatgtattngaaatcaagttgtctctgngtacaggaatacatacttattcccatttttaagcatttgcttctgttttccctacctagaatgtcaggatgtttttcagttatctccccatttgncaaaggtgaccctcaaggataacattttttcattaaagcatctg

SEQ ID NO: 51671 - DNA, 197 bp, Homo sapiens
  misc_feature 25, 177: n = A,T,C or G
tgaataactgcttaaaaatacaccnaaatggaggctgaattttttcttcagcaaaagtagttttgattagaactttgtttcagtcacagagaatcatgtaaacgtaataggatcatgtagcagaaacttaaatctaaccctttagccttctatttaacacaaaaatttgaaaaagtnaaaaaaaaaaaaaaaaaaaa

SEQ ID NO: 51672 - DNA, 174 bp, Homo sapiens
  misc_feature 24, 53: n = A,T,C or G
ttgttcacttggaaaagctttccnagttaacattcctctacaattatcatggntaacagaagtaatatgaaagagcatggactttagaatcagaagatgttagactgtacaacacttttctgtgttcctgaagaaaaaaatagaataaagcaaaaaaaaaaaaaaaaaaaaaaa

SEQ ID NO: 51673 - DNA, 510 bp, Homo sapiens
  misc_feature 15, 20, 40, 41: n = A,T,C or G
atggccgggtccaanccagnagaacaagcatgtctctctnncaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttac

SEQ ID NO: 51674 - DNA, 350 bp, Homo sapiens
aatatttgattatccatttggttgttacagaaaaattcttaactgtaattgatggttgttgccgtaatagtatattgcctgtatttctacctctagtaatgggctttatgtgctagattttaatatccttgagcctgggcaaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgcccctgattttatatacttggatctat

SEQ ID NO: 51675 - DNA, 450 bp, Homo sapiens
  misc_feature 23, 25: n = A,T,C or G
attttgatatccttagggagtcntngaaccaattccccacagatactgagggatgactttttagtaaaaagataagttgctaaaagttcacctaacccaatctgagaatgtcaagaaaaccttagcatgttaacataacctcagagattctacaaaggtctcccagaagaaacgatgcctaaataagacttagtgtggtcatatagaaggagagaaagggtattaatagtaaagagaaggagaaggagtggagccaatgcccagttcagttttgaactgcctccttgatacttccaagaggagattctgccgtcaggtagttagagaaacaagtcttaatctcaggagagacagctagactgtaaacacagatttgggaataatcactagataagcagaaatgagggactgtttacattgtcaaaattggaaggaaagccttgaaattta

SEQ ID NO: 51676 - DNA, 470 bp, Homo sapiens
  misc_feature 179, 180: n = A,T,C or G
ctaaagacagaaaattaaccaagacacattggatttaaactgcacgttagaacaagtgaacctaacatttacagaacatttcattcaatagctaaagaataaacattcctgtgatcagcacatggaacattctccaggatagaccatatgttacgacacaaaaccagtctcaacatatnnataaaggaaccagaattatatcaaatatcttctcaggccgcaatggaataaaagtagaactcaataccaggaggaactttggaaactacacaaatacataaaaactaaacaacatgcttctgaataaccattgagtcaataaagaaattaggagaaattataaaaaattaaaacaaatgaaaatttaaacacagcataccacaacttatgggatacagcgaaagtactgctaagagagtagtttataggaataaatgccctgcatcaaaaaatcagaaaaaattcaaatc

SEQ ID NO: 51677 - DNA, 150 bp, Homo sapiens
  misc_feature 6, 64, 76: n = A,T,C or G
cgatcnatcaccctatagaagaactaatgttagtataagtaacatgaaaacattctcctccgcntaagcctgcgtnagattaaaacactgaactgacaattaacagcccaatatctacaatcaaccaacaagtcattattaccctcactg

SEQ ID NO: 51678 - DNA, 311 bp, Homo sapiens
  misc_feature 52, 290: n = A,T,C or G
ggatacaatgctgcctataatcgcttcttcaggaagcgccgagggaccaaangagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggngtgatactttaaaaaaagaaa

SEQ ID NO: 51679 - DNA, 301 bp, Homo sapiens
  misc_feature 220, 292: n = A,T,C or G
ggtcctagcctttctattagctcttagtaagattacacatgcaagcatccccgttccagtgagttcaccctctaaatcaccacgatcaaaagggacaagcatcaagcacgcagcaatgcaggctcaaaacgcttagcctagccacacccccacgggaaacagcagtgattaacctttagcaataaacgaaagtttaactaagctatactaaccccagggntggtcaatttcgtgccagccaccgcggtcacacgattaaccccaagtcaatagaagccggcgtaaagagtgntttagatca

SEQ ID NO: 51680 - DNA, 400 bp, Homo sapiens
ggccgggggagacaagcagtagtcaataaagagagtgcctttatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggaccttctggtttggggatgcaaatcttcacaaggatagatttcttcgagaacagatagaaaaatctagagatggatatgttgatatatcactaccttgtgtcttttaacaaaaatgaaaaaattgactactgatgggaagttaattgccagagcattgagaagttcagcttgttgtagagctt

SEQ ID NO: 51681 - DNA, 500 bp, Homo sapiens
  misc_feature 24, 420, 440: n = A,T,C or G
aaggagagcaaagaggaaatttgncagggagaaggaggaagctatgaagaaataatggacacagtttatccaaatttgatgaaaaacaacaagcctcatatccaagggtcatttcatagtaatatgttgtttgattgatcaaaaagatataatacctctaaatgtatgtgcatctaatgattccagatccatgaagcagcaatatatagaactaaagaaagcgacaaatccaaatccacagcagtgtagatcttaatatcaggttcttagtaactgatagaacatatagattaaaaatcagtaagaacatagacgatttgaacaatactatcaacccaacttgagccaattgatatttaaaggacaacacacccaacaattttcaaggagaacatggcatttacattaaaataggccagntgctggaccataaaattagnttcaaattttaaaacaccatcttaagaagtttgggggctgaacccagtagaatttgaatt

SEQ ID NO: 51682 - DNA, 400 bp, Homo sapiens
cagttgccacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaagggtgtagcccatgaggtggaagaaatgggctacatttttctaccccagaaaactacgatagcccttat

SEQ ID NO: 51683 - DNA, 261 bp, Homo sapiens
  misc_feature 25, 201, 204: n = A,T,C or G
tctgacttttacaacttacatgttnttatgggaggacctgaaagctatgcctctggaattgttgcaagaactaccagctattggagaagaagagggtgaagggggaggagaggtcatgaggtttttaatctggagcaattcccacctgatgtggatcttaagcctaatttttattgtgtggactattgaaaggactcttgngcngaagaacatctgatatgcttctcaataaactgatgccaaatgtgaaaaaaaaaaaaa

SEQ ID NO: 51684 - DNA, 185 bp, Homo sapiens
tttgggtattctgagattttctcttgcatgcccttagctttacagcttttgcatttcctgttgtatttattctcagccattttgggcatatgtatctttataatcagactggaaacgggactttctattaatatcactttcagaataaaaaataggataatttaaccaaaaaaaaaaaaaaaaaa

SEQ ID NO: 51685 - DNA, 256 bp, Homo sapiens
  misc_feature 23, 118, 183, 208: n = A,T,C or G
gggagaccgaggtgggtggatcncgaggtcaggagatcgagaccatcttcggcaacatggtgaaaccccgtctctactaaaaatacaaaaattagccaggtgttgtggcgcgcgcctnataagtcccaactacttgggaggctaaggcaggagaatcgcttgaacccgggaggcagagcttgnggtgagccaagattgtgccactgcnctcagcctgggggcagagcaacactccatctccaaaaaaaaaaaaaaa

SEQ ID NO: 51686 - DNA, 410 bp, Homo sapiens
  misc_feature 17, 18, 24, 238, 404: n = A,T,C or G
acacctaatagaaaggnntactancatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggntttataaaattatcttccagtttgtacatttatatggaattgttctttatcaagggtagctaatgacatgaaaaataattgtgaaatatggaattattttctgacacatgaagcccactaaactatgctttcttataatgcatattttcttctcaggtttaaatgnatgtaa

SEQ ID NO: 51687 - DNA, 270 bp, Homo sapiens
  misc_feature 169, 219, 249, 263, 268: n = A,T,C or G
tatggccgggggaatccggacactcaagacttttgactgcctttttgtttgttcagtggagactccctggccaacagaatccttcttgatagtttgcaggcaaaacaaatgtaatgttgcagatccgcaggcagaagctctgcccttctgtatcctatgtatgcagggngctttttcttgccagcttgggccattcttgcttagacagtcagcatttgnctcctcctttaactgaggcatcatcttagnccaactaatgcagnccganac

SEQ ID NO: 51688 - DNA, 410 bp, Homo sapiens
  misc_feature 49: n = A,T,C or G
aaagtccctagttaatataacgttttttgctagttggttatctgcgatnggctgaagctccattcaaaattaatcagtcacaaggaatgcctctaagttaagttttggtttgcttatttatgtaagggttcctagtacagaaacaaccccagactaatggtttcttgcttattttggcttaacagcttgttaatgataggtatgcagtaatttgtgataaagagggaaaaaaagatgaagagaaatattaggaatagaagtattagtaatgaaaaaaagacgtaattagatcaggaatagaagtattagtaatgaaaaaagacataattaaattaggtggaaattaaaataaaagactattaagaacaacttcgtgccaataaaatttgaaaaaaaaaaaaaaaaaaaaa

SEQ ID NO: 51689 - DNA, 430 bp, Homo sapiens
  misc_feature 25, 418: n = A,T,C or G
ggaaacactggtggacagattctantgctgagaagaaacacgtttggtttggagagtccatggatggtggttttcaagtttagctacggcaatcctgaacctcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcacccctatgacattggngggccctgatca

SEQ ID NO: 51690 - DNA, 450 bp, Homo sapiens
  misc_feature 22, 24: n = A,T,C or G
ataaataagagttccattaggngncacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggggcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagatttttccatgcatttgcaaatacgtatattctttttccatccacttgcacaatatcattaccatcacttttttcatcattcctcagc

SEQ ID NO: 51691 - DNA, 310 bp, Homo sapiens
  misc_feature 172: n = A,T,C or G
gagatggtcacctgatcaggatcatttaattgcaactagattttcagctttttaggggcagggacacagtcataattgttttctccattgtaccacgtactcagtgttcagtatttgagtaggtgaatacaattattcatgtattaaataagattcttagagcatgggtcangaactagtcagttcattcttcttaatttgtggttccattttctaacccaatccctgttttcagtaacactcttgtacttccagcaaccagtcccccgcccccaaatcctgtggtcctatcatttaaaaaaaaaaaaaa

SEQ ID NO: 51692 - DNA, 130 bp, Homo sapiens
  misc_feature 17, 22, 48: n = A,T,C or G
cccgcttcagatagatnattgnccagatatttcacatttttgtatggnggaaataaaaatgaaaaatgtatttccaaaagatgaaaattaaaaacattttcataggaaaaaaaaaaaaaaaaaaaaaaaa

SEQ ID NO: 51693 - DNA, 345 bp, Homo sapiens
atgaatttaatcttttttgaaagcactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccaccctttataccggaagactctg

SEQ ID NO: 51694 - DNA, 410 bp, Homo sapiens
  misc_feature 365, 366: n = A,T,C or G
tagatatgttaattaccttggtttaatcattccacaatgtatatatataacaaaaaagtatattgtgtgctgtaaatatatacaatttttatttgtcaattatgcttaatgaagttgggagaacaatatatctacaaaatcctcaaatatgtgaaatgcaaatcaaacttctaatatatatataaatatatacgaatattgacaaatatatacaaatatatataaatgtttgatatatgtaaaatatgtattgaagaaaagtactataagaaaaattacaaaatattttgatggaatgataactgatacaaaataccaaaatttgtagaatgctgctaaaaagtatttagaaggaaatttatagnntttaaatgtttatactagaaaggattagaaaggaaaaaaggttt

SEQ ID NO: 51695 - DNA, 400 bp, Homo sapiens
  misc_feature 50: n = A,T,C or G
gcagcgagtcttgaagctctgtttggtgctttggatccatttccatcggnccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattaagtc

SEQ ID NO: 51696 - DNA, 212 bp, Homo sapiens
  misc_feature 20: n = A,T,C or G
taaagtgctaaatatttgtnagaataattgaatttgatagagaatgataaagtttgctattttcaaaaaagaaaaccttgcctaacaaaatatttaaaatgtcatcaaagagtagcctttaaaaaatgttgtcaaaggtcacttgatacttggatgattaaataaatcagggatgataaaatccttagtgctaaggctgacttacaaaaaaa

SEQ ID NO: 51697 - DNA, 400 bp, Homo sapiens
  misc_feature 307, 313, 359, 362, 389: n = A,T,C or G
atatcctatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggntttggntccaaactcaaccagcaatgttgagagctgaacttaagatagctgntgnactttttgcttttccatctgttactgnccttcatttct

SEQ ID NO: 51698 - DNA, 430 bp, Homo sapiens
  misc_feature 419: n = A,T,C or G
gaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgnctaagacaagt

SEQ ID NO: 51699 - DNA, 480 bp, Homo sapiens
  misc_feature 23, 40, 474: n = A,T,C or G
tctagccttgtttggatgttttnagttgattttttatggngcctctcttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagcccgagtggcatgaatatgtgnactggt

SEQ ID NO: 51700 - DNA, 400 bp, Homo sapiens
attacaagccaagctagtagcccgagttcaaactgtgaaatttcatataatacagtgatgagtttggattttattatgttggcaatgggaatttggcattttagaaagattcttctggctttaatgtggaagaaaaatcggaaacaaacccaacctagacagataattaaataaaaatcataaaaggctaatgtgttataaatggaaatgaagagaagagagacataagagagataaaaggtttttgtttacgtgaactaaattatacaatctgccacagttcatacgaattttgctgggcattaacagaaatagcctttcatatcactagcagcaactggtcccataaccctcctttcttgctactcagatcaatctcttcttgtggacaatcattgat

SEQ ID NO: 51701 - DNA, 170 bp, Homo sapiens
  misc_feature 24, 132, 150: n = A,T,C or G
tggtaaaattcccacttgaatgcnacactgataataattatgctgatttttagcatctcttataggaatcaaagtttattaaagttacatagaggattgaaaaatgtatatcactcaatttttatctaaganggataggttataaagggnggtacctaaatactcaaata

SEQ ID NO: 51702 - DNA, 230 bp, Homo sapiens
  misc_feature 25, 69: n = A,T,C or G
tttaatcttttgaaaagtaaattcnttgtttactggtttgactataattctctgttatctttacgaggnaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaaaaaaaaaaaaaaa

SEQ ID NO: 51703 - DNA, 440 bp, Homo sapiens
  misc_feature 23, 49, 393, 415: n = A,T,C or G
gccagcgtactatggcattctgnggctctgctgtgagcagtctcctgcnttcacacgacaactggcttctcaccagaacatccagtgggcctttaagaatcttacaccgcatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgnggatattatctcattttaatgntctcaccaagacttactttatagac

SEQ ID NO: 51704 - DNA, 440 bp, Homo sapiens
  misc_feature 6, 31: n = A,T,C or G
aacccncaggtcctaaactaccaaacctgcntttaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaatgatatcatctcaacttagtattatacccac

SEQ ID NO: 51705 - DNA, 430 bp, Homo sapiens
  misc_feature 24: n = A,T,C or G
gcggaggttgcagtgagtcgagancgtgccattgcactccagcttgggcaacaagagcgaaactccatctcaaaaaaaaacaaccagagtaaataattggatttattccattggttctatcaaaacaacttattaagatggaacttctaatacgtctgaactgtaacactgcatttaagcccatttctttgccatactttgccgtctgttatttaactgacctcataaaatcctcaagaaaacgatttcttaagaaatgctcagttacagctgcatcaaacatcttctccaaaatgcctttcaagagcaccaaataattttagtgtaacataatcattgaatgtctgttgttctcagaaaagaactaacgttggagaaagtaattaaagccagatcctaaaagtcaatacatctgaggctccagacactg

SEQ ID NO: 51706 - DNA, 210 bp, Homo sapiens
  misc_feature 4, 13, 45, 104, 153, 155, 167, 174: n = A,T,C or G
ggcncaatttgtncgaaaccttgtggagaagaccccggcgctggngaacgctgctgtgacttactcgaagcctcgattggccacattttggactacgccaaggntgagctgggtcctcccacccctgctgagatccctagagctattcagagncngaaaaaaatagncaatagngctcagactgggagcttcaaacagctcacagttaag

SEQ ID NO: 51707 - DNA, 361 bp, Homo sapiens
  misc_feature 7: n = A,T,C or G
aaacagnaattgctttagatttccaaagtagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacctcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaaa

SEQ ID NO: 51708 - DNA, 350 bp, Homo sapiens
  misc_feature 23: n = A,T,C or G
gctgagggggcaggcggagcttnaggaaaccgcagataagtttttttctctttgaaagatagagattaatacaactacttaaaaaatatagtcaataggttactaagatactgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggt

SEQ ID NO: 51709 - DNA, 453 bp, Homo sapiens
  misc_feature 23: n = A,T,C or G
gggtcctctggtgcgaaattccngatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccagaaaaaaaa

SEQ ID NO: 51710 - DNA, 380 bp, Homo sapiens
taaaggctttaaattataacatatgggattcttagtagtatgtttttttcttgaaactcggtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttc

SEQ ID NO: 51711 - DNA, 500 bp, Homo sapiens
  misc_feature 74, 121, 479: n = A,T,C or G
ggcctgcaattgcaaaatgcttacgagaaaaatggtctcaccctccatcatgcataaaaacagattgtctcagnttacctagctttgaaaatgccatacccatgggagagaagaaggatgngtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatataggtggtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccggtgncagtatatgctccagcttcat

SEQ ID NO: 51712 - DNA, 500 bp, Homo sapiens
ggactggtctttctatctcttgttctacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcgacttagaggtggggagcagagaattctcttatccaacatcaacatcttggtcagatttgaactcttcaatctcttgcactcaaagcttgttaagatagttaagcgtgcataagttaacttccaatttacatactctgctta

SEQ ID NO: 51713 - DNA, 390 bp, Homo sapiens
  misc_feature 27, 372: n = A,T,C or G
tttgttagtgagtcccggctgacttgnagtgataaagaaaagcatggagctgtgtctgcagacaatggtggctgcatctgtaagtggcttcagaggcagcagccctggggaaattgatgggtgtggcaagtggacctgtgaagagggagaatctagccttcagcctgtccagtgttaaccactagagaaactgagctttatatccttttttaatgcctgtgaattttagtatattgaaacattagagcaaatactcaggggatttttcattaaacatccctcagataatttagctatatatcattagaaagggaaagctatcatttttattttaaaactaaacaaggccatcttataaactgtcaccaaagncttcccttttttattgca

SEQ ID NO: 51714 - DNA, 300 bp, Homo sapiens
  misc_feature 32, 58, 180, 251: n = A,T,C or G
aatttcccgacatttgtataaaagaatttgtnataaatatatccaggtgctcaccaanggaaacatgtattaacaacttaaattagatttttctaactgatagttttcactcatttataatcagtaggagagactgtctagatgttggggcagctctatgatttaagtctgtaacatgtnctaactgaatttagtaccctagttttgttaagctattaggattttctaatagaacttactccccctgcctncccagccttatgtttcttttaatgacttctgggtcctgggctccctttg

SEQ ID NO: 51715 - DNA, 230 bp, Homo sapiens
  misc_feature 21, 74, 91, 111, 165: n = A,T,C or G
aaaatggagctcgaggccatnagcagatataccagcccagtgaacccagctgtcttcccccatctgaccgtggngcttttggccattggantgttcttcaccgcctggttncttcgtttacgaggccacctctaccaggtacactcgtgatatctataaagagcncctcatctccttaggggcctcactcttcatgggcttttggagtcctcttcctgctgctctgggtt

SEQ ID NO: 51716 - DNA, 179 bp, Homo sapiens
  misc_feature 15, 33, 54, 136: n = A,T,C or G
acaaaaatgctctgnattcctagtgtttaaggntcaatatcagtgtatataacngaacacactcatccatttgtgcttttgtttttttttatggggcttaaagtaaagagcccatcctttgcaagtcatccatgtngttacttaggcattttatcttggctcaaattgttgaagaatgg

SEQ ID NO: 51717 - DNA, 300 bp, Homo sapiens
  misc_feature 112, 183, 212: n = A,T,C or G
acaagcaagtagttattatcaatttgcattgtttgaaacagcagaaagataaatataaaaacttgtaatatatttttcatttgtttccagaaaagtgacatcaatgtacagngttttgtaatcctctcactgttagtcaattttaaattattttgaggccgggcgtggtggctcaccgcctgnaatcccagcactttgggaggccaaggcanggtggatcacgaggtgaccgagatcgagaccattctggcccacatgggcaaactctgtctctactaaaaatacaaaaattagctgagc

SEQ ID NO: 51718 - DNA, 160 bp, Homo sapiens
  misc_feature 114, 150: n = A,T,C or G
cagaaatcctgcaatgaaaggtactatatttgctagactctagacaagatattgtacataaaagaatttttttgtctttaaatagatacaaatgtctatcaactttaatcaagntgtaacttatattgaagacaatttgatacataatanaaaattatga

SEQ ID NO: 51719 - DNA, 195 bp, Homo sapiens
  misc_feature 30: n = A,T,C or G
cagtctaccatattatgttacagataatanaggaaaaacggggttactagtagccgcccatagcctgcaacctttgcactccactgtgcaatgctggccctgcacgctggggctgttgcccctgcccccttggtcctgccccctagatacagcagtttgtacccacacacctgtctacagtgtcattcaataaag

SEQ ID NO: 51720 - DNA, 120 bp, Homo sapiens
aactggccacccagctgaccggaccggtcatgcccgtccggaacgtctataagaaggagaaagctcgagtcatcactgaggaagagaagaatttcaaaggccttcgctagtctccgtatg

SEQ ID NO: 51721 - DNA, 148 bp, Homo sapiens
  misc_feature 52, 54, 95: n = A,T,C or G
ttttgatacgtgaatgaaccttgaaaatatactacgtgcaataaatcagacncnaacggacaaatattgtatgattctgctttatgaaatatgtntgaataggtagattcatagggacagaaagtagattagaggttaccagcaattt

SEQ ID NO: 51722 - DNA, 240 bp, Homo sapiens
  misc_feature 36, 176, 177, 179, 183: n = A,T,C or G
tccaaatttccctggaaagtaagcctcgctcttgcnaaagaaaaagtctggcttggagagtctctggagcccaggatgccagcatgtgccaatgactgtcaccttcatctcttcaaaagaaaagccatagccgaggactgtcccgcgacccccgtggactgcgctaggtcatgtgnngnctgntttcatttctcatcccatccaatttgtccttttctcctgtcattttcttcctctgtg

SEQ ID NO: 51723 - DNA, 290 bp, Homo sapiens
  misc_feature 203, 204, 244, 279: n = A,T,C or G
ccatctgaatcaaatgtgttctccatagctgcctgtcctaggctgactcaccagggctccacatcttgactttgctatgccacctcatttccacgtgagaaggaagtgcacgttcagggtggttggtcagagttaagtcagcctgtatccgtggggtgaaattaacagacatgtgggaattgaaccttaaacattctcagggnncactaggaacctaaaattataatcacgccacagagattgnaaatttgaaatttaccttgtttccatggaaatttngaattcaaaac

SEQ ID NO: 51724 - DNA, 118 bp, Homo sapiens
  misc_feature 30: n = A,T,C or G
aaatttctttttaatacttgtttcagcctntttaatctctttataagtgaactaataaatctattttcttcagacttctgcaatagttctttaaaatcacaacagttagcaagctgac

SEQ ID NO: 51725 - DNA, 170 bp, Homo sapiens
  misc_feature 158: n = A,T,C or G
ggcaagatctccaagctgacccttacacgttaaaacttttgcctgtaagaatttgcacatgaatgttaatggaaaacacaaaacttaagatggcccaaaacaaaagccacaaacagttcatcatttggtgcttagtctttgtaagggctctctgtggnttgacttactcc

SEQ ID NO: 51726 - DNA, 120 bp, Homo sapiens
  misc_feature 87: n = A,T,C or G
accataatgagatgtgagccttgtgcatgtgggggaggagggagagagatgtactttttaaatcatgttccccctaaacatggctgntaacccactgcatgcagaaacttggatgtcact

SEQ ID NO: 51727 - DNA, 360 bp, Homo sapiens
  misc_feature 321, 339, 354: n = A,T,C or G
gtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctgccttggatttccacaagacggcaccctatgtcgtcactggcagcgtagatcaaacagtaaaagtgtgggagtgccgttgattgtgtctccttcggcccctcctccctcttttcctctggatgcacctctgatgataccatggntaccccattgagctctgnttaaataaatattgncctttc

SEQ ID NO: 51728 - DNA, 290 bp, Homo sapiens
  misc_feature 25, 60, 61, 195, 267, 269: n = A,T,C or G
acgttggtgttgaggttagcatacntatcaaggacagtaactaccatggctcccgaagtnntgccaaaacctcggatgcgtggccttctggccaggcgtctgcgaaatcatatggctgtagcattccgtgctatccccgggggttgcagctttgtgtaagtttcgtgtggctgatcaaagaaagaaggcataccncagatttctacagaaaactacgatgtcatgaaaagattttgaggagatgaggaaggctggatctttcagagngnaaagtaatcttggaatataaa

SEQ ID NO: 51729 - DNA, 390 bp, Homo sapiens
  misc_feature 24: n = A,T,C or G
caaaaatgccctagaaatatagantttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttaga

SEQ ID NO: 51730 - DNA, 173 bp, Homo sapiens
acattactgttgtattaaaaagccagttcaggcttaatatatatgactactataagtcaacctcacattttaatgtatgaagaagattgtatgaacgatcacattaattcatttaaataggtatgtattttgatactaatttttaagaagaaatgtatcattctcatggaaat

SEQ ID NO: 51731 - DNA, 171 bp, Homo sapiens
  misc_feature 53: n = A,T,C or G
tataaaaacaagcccagactgggagaaaaatatatgtaaatcacttatctggnaaaggactgctatctagaatatataaagcactatcaaaactaaataataagaaaacagtctagtaactaaatggacaaaataatccaacaaataggcaacccggaaaaaaaaaaaaaa

SEQ ID NO: 51732 - DNA, 178 bp, Homo sapiens
  misc_feature 26: n = A,T,C or G
ccaaaatgtttggaaacagtataacnttgacaaagaaaaatgatacttctctttttttgctgttccaccaaatacaattcaaatgctttttgttttatttttttaccaattccaatttcaaaatgtctcaatggtgctataataaataaacttcaacactctttatgataaaaaaaaa

SEQ ID NO: 51733 - DNA, 320 bp, Homo sapiens
  misc_feature 23, 143, 176, 177, 295: n = A,T,C or G
ttgattgttgactccaggcttanccatatcagaaggttctttttgccatttggcctgtggatgtctgagaagatcattcacaatacatgtaaaattcaggtaggcctaaggaaaggccagcctgtagaaagcaaaatggcagngtctgttctccactgttggaggcattatgtaanngagggatcctgttagccactgtctttctgctaattaagtggggctgaacaagtaagcactaataataccagtgaaccacttgggcaccttgtgggtagagttttgctgccaccctagnggaatgggatatcaattgcttccat

SEQ ID NO: 51734 - DNA, 146 bp, Homo sapiens
cagatgttgtaattatcagatcgtaattttaaagcagccatcacaaaaccgcctcagtgagcaatcacaaacactcttgaaacaaatgaaaaattagtctcagaaaagaaatggaagccataaggaagaaccaaaaaaaaaaaaaa

SEQ ID NO: 51735 - DNA, 292 bp, Homo sapiens
ttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctggtccaccaaatacaattcaaatgctttttgttttatttttttaccaattccaatttcaaaatgtctcaatggtgctataataaataaacttcaacactctttatgac

SEQ ID NO: 51736 - DNA, 235 bp, Homo sapiens
  misc_feature 176, 178, 216: n = A,T,C or G
atgtgaagagtgcattacactatcccttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgngnattaccaacttgataaaatgctactcataagagctggnttggggctatagcatatgc

SEQ ID NO: 51737 - DNA, 400 bp, Homo sapiens
  misc_feature 50, 118, 200, 211: n = A,T,C or G
atctgtgggagcagtttattcctttatcacccagggtgcagccacaccanggactgtgttgaagggtgttttttttcttttaaatgtaatacctcctcatcttttcttcttacacagngtctgagaacatttacattatagataagtagtacatgggggataaccttctacttttaggaggactactctcttctgacagncctagactggncttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttcca

SEQ ID NO: 51738 - DNA, 290 bp, Homo sapiens
  misc_feature 49, 207, 284: n = A,T,C or G
ttgtttcaaaatgtaaagagttttttgggcacagtggctcatgcctgtnatcccaacactctgggaagctgaggtgggtggatcacctgaggtctggagttcgaggccaacatggtgaaacccgtctctactaaaaatacaaaaattagctgggtactaaaaatacaaaaattagtggtggtgggcaccctgtaaatcccagctatnggggaggctgaggcaaggagagaattgcctgaactcaagacgcagaggttgcagtgagtggagactgtgccactgcnctccag

SEQ ID NO: 51739 - DNA, 410 bp, Homo sapiens
  misc_feature 23, 24, 206, 266: n = A,T,C or G
gaagctgacagcattcgggccgnnttgtctcgctccgtggccttagctgcgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgnagaatggagagagaattgaaaaagtggagcattcagacttgtctttcagcaaggactggnctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaggat

SEQ ID NO: 51740 - DNA, 170 bp, Homo sapiens
  misc_feature 24: n = A,T,C or G
gacgacccattcgaacgtctgtcntatcaactttcgatggtagtcgccgcgcctaccatggtgaccacgggtgacggggaatcagggttcgattccggagagggagcctgagaaacggctaccacatccaaggaaggcagcaggcgccgcaaattacccactcccgaccc

SEQ ID NO: 51741 - DNA, 136 bp, Homo sapiens
  misc_feature 19, 22, 47: n = A,T,C or G
cagctgaagatgatgaggnttncgatgtcgataccaagaagcagaanaccgacgaggatgactagacagcaaaaaaggaaaagttaaactaaaaaaaaaaggccgccgggacctattcaccctccacttcccgtct

SEQ ID NO: 51742 - DNA, 259 bp, Homo sapiens
  misc_feature 180, 181, 185: n = A,T,C or G
ctgctcttgcaccaaattatcttgcacattcaaatttgtctggttaaaaaataggtggtagatattgaggccaagaatattgcaaaatacatgaagcttcattgcacttaaagaagtatttttagaataagaatttgcatacttacctagtaaaacttttctagaattatttttcactcnnaggncatgtatgtttctctttgattatttgcatgttatgtttaataagctactagcaaaataaaacatagcaaatggc

SEQ ID NO: 51743 - DNA, 360 bp, Homo sapiens
  misc_feature 57, 287: n = A,T,C or G
attcctgaagctgacagcattcgggccgagtatgtctcgctccgtggccttagctgngctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaggaatggagagagaattgaaaaagtggagcattcagacttgtctttcagcaaggactggtctttctatctcttgnactacactgaattcacccccactgaaaaagatgagtatgcctgccgtgtgaaccaatgtgactttgtcacagg

SEQ ID NO: 51744 - DNA, 128 bp, Homo sapiens
aaataccgatgatgatgatgatgaaaactttttgatttttcaagagatctttctttccaaacatttctggacagtacctgattgtattttttttttaaataaaagcacaagtacttttgaaaaaaaaa

SEQ ID NO: 51745 - DNA, 400 bp, Homo sapiens
  misc_feature 180, 182: n = A,T,C or G
ctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgnantagatattataagaaatctagaaatgatttaaagcatacaggaggatgtgcataggttatatgcaaatactatgctattttatatatgggacttgagcatttgtggattttgatactgggggatccctggaaccaatcccccatggataccaaaagtacgactgtggttatctatttttttttacatacttattattaccaccatgctcagtaagtcc

SEQ ID NO: 51746 - DNA, 200 bp, Homo sapiens
acatggatgaggagactggcaatttgaaaaaggctgtcattctacagggctctaatgatgttgaacttgttgctgagggcaacagcaggttcacttacactgttcttgtaagatggctgctctaaaaagacaaatgaatggggaaagacaatcattgaatacaaaacaaataagccatcacgcctgcccttccttgatat

SEQ ID NO: 51747 - DNA, 143 bp, Homo sapiens
  misc_feature 24, 54: n = A,T,C or G
gaaaaaaagctgaacatcactgancattagagaaatgcaaatcaaaaccacagngagatgccatctcacaccaatcagaatgacaattattaaaaaagtcaaaaaacaacagatactttcgaaaaaaaaaaaaaaaaaaaaaa

SEQ ID NO: 51748 - DNA, 350 bp, Homo sapiens
  misc_feature 153, 155, 303, 314, 325, 336: n = A,T,C or G
aatgggccgcgagtttgggaatctgacgcggatgcggcatgtgatcagctacagcttgtcaccgttcgagcagcgcgcctatccgcacgtcttcactaaaggaatccccaatgttctgcgccgaattcgggagtctttctttcgcgtgggggngnagtttgtagtgttttatcttatctacacatgggggactgaagagttcgagagatccaagaggaagaatccagctgcctatgaaaatgacaaatgagcaaccgcatccggatgacggttcccttgtctctgaaagaccttttctctggnaagaggagtcntgcattgaagnggcctcaaaanacacaataaacttc

SEQ ID NO: 51749 - DNA, 174 bp, Homo sapiens
  misc_feature 2, 90, 102, 147: n = A,T,C or G
gnatttcaagcgttttaatgcaccgcagtatctgcgtttatctcacaacgaactggctgatagtggaatacctggaaattctttcaatgngtcatccctggntgagctggatctgtcctataacaagcttaaaaacataccaactgncaatgaaaaccttgaaaactattacct

SEQ ID NO: 51750 - DNA, 255 bp, Homo sapiens
  misc_feature 22, 201: n = A,T,C or G
gaagcaggcggatcacaaggtnttttagatcgagaccatcctggctaacatggtgaaactccgcttctactaaaaatacaaaaaaattagccaggcatggtggtgggtgcctgtagtcccagctactcaggaggctgaggcaggagaatggcgtgaacctgggaggcggagattgcagtgagctgagatcgtgccactgcnctccagcctgggcgacagagtgagactccatctcaaaaaaaaaaagagaaaaaa

SEQ ID NO: 51751 - DNA, 400 bp, Homo sapiens
  misc_feature 26, 49, 202, 205, 369: n = A,T,C or G
tccatataagaattcaacagattttnggcaggaagacccttactactgnccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgnagngattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggnccgcttttaacttggactagtgtaactcctt

SEQ ID NO: 51752 - DNA, 250 bp, Homo sapiens
  misc_feature 26, 172: n = A,T,C or G
acaggtgtagaagttaaggacatttnattggtcatgtcacaagcaaatgtcgtcgagagcaaaggcagtccgagccctgaagaacaacagtaatgatattgtaaatgcgattatggaattaacaatgtaaccatatggaagcaactttttttggtgtctcaaaggagtaacntgcagcttggtttgaaatttgtactgtttctatcataaataaagttatggcttcttgttggtaaaaaaaaaaaaaaaa

SEQ ID NO: 51753 - DNA, 206 bp, Homo sapiens
tgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgggaaaaaaaaaaaa

SEQ ID NO: 51754 - DNA, 349 bp, Homo sapiens
  misc_feature 180, 181, 336: n = A,T,C or G
gccagagcccgcttggctaatacccagggaaagaaggccaagaggaaagcaagagagaaacaattggaagaagcaagacgtcttgctgccctccaaaaaaagaagagaacttcgagcagctggcatagaaattcagaagaaaagaaaaaggaagagaggagttgattataatgccgaaannccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcnttcaaaaaaaaaa

SEQ ID NO: 51755 - DNA, 234 bp, Homo sapiens
  misc_feature 1, 2, 9, 14, 23, 27, 44, 97, 200: n = A,T,C or G
nntcttggnccagngaccccgtntttnatggccgggaaaccccnaaacagtacaagcaacccaaactgtttccccctcaaaagccaaaaaaatgggngacaatttcacatggactttggaaaatatttttttcctttgcattcatctctcaaacttagtttttatctttgaccaaccgaacatgaccaaaaaccaaaagngcattcaaccttaccaaaaaaaaaaaaaaaaaaa

SEQ ID NO: 51756 - DNA, 134 bp, Homo sapiens
cctctgccctggacctgtgacacctctggactatttctgtgtttatttgtggccgagtgtaacaaccatataataaatcacctcttccgctgttttagctgaagaattaaaaaaaaaaaaaaaaaaaaaaaaaa

SEQ ID NO: 51757 - DNA, 320 bp, Homo sapiens
  misc_feature 25, 271: n = A,T,C or G
ccctttacttttccttccatgtgtnttttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctgggcagagatgaagccacgcctttccatttttcaatgctgcatatttaatctgcaacaaaaatgttaagccataacagcctttttatattttagnttgtcacctttgcattgcagaataaatactgaataaccatcaaaaaaaa

SEQ ID NO: 51758 - DNA, 400 bp, Homo sapiens
  misc_feature 25, 178: n = A,T,C or G
cgcatgggcctcacctcctctgtgntttctttctttgcaccaaagaacatcagtctccaacatgtttctgttttgttgtttgattcagcaaaaatctcccagtgacaacatcgcaatagttttttacttctcttaggtggctctgggaatgggagaggggtaggatgtacaggggtangtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagat

SEQ ID NO: 51759 - DNA, 241 bp, Homo sapiens
gatgattgtcataaggtttttagcttgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaaaaaaaaaa

SEQ ID NO: 51760 - DNA, 480 bp, Homo sapiens
  misc_feature 23, 208: n = A,T,C or G
tatgtttcaactgtattatttgncatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaaggggntgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagcccc

SEQ ID NO: 51761 - DNA, 274 bp, Homo sapiens
  misc_feature 26, 70, 137, 170, 172, 173, 178, 179, 180, 182, 186, 201,204, 210, 218, 226, 237, 238, 239, 244, 247, 250, 252, 253,254, 256, 259, 260, 261: n = A,T,C or G
attttttggcccagggaaccctcgtntcttatggccggggtgtccatcgagtcacgtctgaaacccctgntagccccgacttctttttaattaaaataaggtaagcccttcaaaaaaaaaaaaaaaaaaaaaaaaangggaaaaaaaaaaaaaaaaaaaaaaaaaaaatntnnggggnnncngggncccggcttttttttnttngggggntttttttngggggggnggatttggggnnnttttnggnaantnnncnttnnngggggggaaaaaa

SEQ ID NO: 51762 - DNA, 400 bp, Homo sapiens
  misc_feature 180, 307, 389: n = A,T,C or G
tgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgnaaaatccttggaaaaggtgtgtgctgacttgataagaggcgcaaaagaaaagaatctcaaagtgaaaggaccagttcgaatgcctaccaagactttgagaatcactacaagaaaaactccttgtggngaaggttctaagacgtgggatcgtttccaggatgagaattcacaagcgactcattgacttgcacagtcccttctgagattgntaagcagatta

SEQ ID NO: 51763 - DNA, 287 bp, Homo sapiens
  misc_feature 57: n = A,T,C or G
cacgacgaccttgaataaaaattgcacacactcagtgcagcaatatattaccagcangaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgcttttttttttt

SEQ ID NO: 51764 - DNA, 400 bp, Homo sapiens
  misc_feature 203, 341: n = A,T,C or G
atccgttgcaaacccaaagggaccttagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgnaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggngctattcttgtgtcaaacacctctgtattttttaaaacatcaattgatattaaaaatga

SEQ ID NO: 51765 - DNA, 343 bp, Homo sapiens
  misc_feature 6, 36: n = A,T,C or G
acatgncccacttcctaaagcgtgtttctttttgtnagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgctaaaaaa

SEQ ID NO: 51766 - DNA, 430 bp, Homo sapiens
ttccaggtactaaggacccaaggcctacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtggtccattttaactgggataaatgtttttgtaaaaatacaaccatagaaaggcctctttgttacaaaatgatttgcaaagaaataactgctttgtttgcaagattaaattagtgttggcaaaataaagttctaaagataatactaaacacttttgcttatcagccaacatctacataagctaaaattgaatacagttcctttataatttgaatgacaggttttaacatcttctttaaaaccttaaaaatcac

SEQ ID NO: 51767 - DNA, 440 bp, Homo sapiens
  misc_feature 25, 26, 50, 203, 207: n = A,T,C or G
cgaagaattgatccttggcagagtnncaacacagttttgtagagaaagantagtacttccaacaaatggttctgggataactgaatgcaaaagaatgaagttggacctgtacctcacactatctgcaaaatttaactcaaaatggattatagacctaaaaataagagctacaatgataaatttttagaataaaacctaagagnggtngtgactttgggttaggcagtgatttttatagatataacacaaaaagcataagtgacaaaagaaaaaattgataaattgaactttatgaaaactggaaactttttatgcattaaaggacattatcaaaggaagtaaaagaaaaactcactgaatggaagaaaacactttcaaatcaaatatatgagaagggatttgtagccagaatttataaagaaccctcatattcataatga

SEQ ID NO: 51768 - DNA, 500 bp, Homo sapiens
  misc_feature 178: n = A,T,C or G
aaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagtnggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaa

SEQ ID NO: 51769 - DNA, 246 bp, Homo sapiens
  misc_feature 23, 150, 178: n = A,T,C or G
cccaggctggacatgctgactgncctctcccctccagcctttggccttggctttttctagcctatttacctgcaggctgagccactctcttccctttccccagcatcactccccaaggaagagccaatgttttccacccataatcctttntgccgacccctagttccctctgctcagncaagcttgttatcagccttcagggccatggttcacattagaataaaaggtagtaattagtaaaaaaaa

SEQ ID NO: 51770 - DNA, 196 bp, Homo sapiens
  misc_feature 25: n = A,T,C or G
ggcatcattataagctatgagttgnaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaagaaacaaaaaaaaaaaaaaaaaaaaaa

SEQ ID NO: 51771 - DNA, 319 bp, Homo sapiens
  misc_feature 24: n = A,T,C or G
acggtggtaggatgcatcttcatngttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaataaaaaaaaaaaaaaaaaaa

SEQ ID NO: 51772 - DNA, 110 bp, Homo sapiens
acgacactgcgggccgcttgcacctggatccctaacctgttattgtctgtgctgcactgtcacggacggcaagaaggcacattattctttttgaaggtaccttgctactt

SEQ ID NO: 51773 - DNA, 349 bp, Homo sapiens
tgaccctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctggaaaaaaaaaaaaaaaaaaaaaaaaa

SEQ ID NO: 51774 - DNA, 420 bp, Homo sapiens
  misc_feature 48: n = A,T,C or G
caatggggaaccattgagtgtttttgagtgagggaattatatggtagnactgctttgctttagcaaaattaattttttagcagtgtttagagtggatttcagagtggactagggtaagtgctctaaaggagtagataccacatgcagctgaagctcagaggaaagggaggtgagctttgcctgggggagttagggaatggtttgtagaacatttgacctaggcctggaaggatgaatttggtgagtcagtgagtggggcggccaagatatttctggaggagagactactggagagcctttcttatcaggctgcttgtgcgaatgggcttgactagcaggcatgtatttagatatcatcttgctttgaaagggatttacaacagcttaaaaaaatgtaccacaacaaggaaaaaaaaaaaa

SEQ ID NO: 51775 - DNA, 300 bp, Homo sapiens
  misc_feature 178: n = A,T,C or G
gatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgntggaggaaccagtagtcctggcattggctgaaaagtatggccgatctccagctcagatcttgctcaggtggcaggtccagcggaaagtgatctgcatccccaaaagtatcactccttctcga

SEQ ID NO: 51776 - DNA, 207 bp, Homo sapiens
tatggccgggggttctaagacgtgggatcgtttccagtatgagaattcacaagcgactcattgacttgcacagtccttctgagattgttaagcagattacttccatcagtattgagccaggagttgaggtggaagtcaccattgcagatgcttaagtcaactattttaataaattgatgaccagttgaaaaaaaaaaaaaaaaaaaa

SEQ ID NO: 51777 - DNA, 285 bp, Homo sapiens
agctggagatatttcggatgataatctacctcactttccctgtggctatgttctgggtttccagtcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgtaaaaaaaaaaa

SEQ ID NO: 51778 - DNA, 500 bp, Homo sapiens
  misc_feature 1, 9, 26, 28: n = A,T,C or G
ntctttggncccagggaccctcgttntntttatggccggggttgccaaacaacttctcattttgaatagtgtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttga

SEQ ID NO: 51779 - DNA, 300 bp, Homo sapiens
  misc_feature 25, 34, 70, 95, 128, 154, 161, 243, 274: n = A,T,C or G
aatggtgcctcaggtatgatatgcntaggaaatngatgaccaaatatatgctatcagatattcattttgnctgggagaattttctcctttagtanccatgttacttttcaatcactgagaagcatttncttggctatcatatttagcctgctanaaacagngcattaaatggaataggcatcttgaataataagacaaaaattcatatttgccatttgaaagtatatttctttcataaatgcnggcctataataaaacgaaatcattttgtaanattgattttacttgttttagatttgc

SEQ ID NO: 51780 - DNA, 292 bp, Homo sapiens
tactctcttgcaccaaattatcctgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagtaaatggcaaaaaaaaaaaaaaaaaaaaaaaaaaaaaaaaa

SEQ ID NO: 51781 - DNA, 339 bp, Homo sapiens
ttaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacacggtctcctgagaacttcaaaaaaaaa

SEQ ID NO: 51782 - DNA, 400 bp, Homo sapiens
gttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaac

SEQ ID NO: 51783 - DNA, 470 bp, Homo sapiens
  misc_feature 24, 47: n = A,T,C or G
aggctgtacattgaataaaaagtntcgaaatgcacagttagcacagnataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaatgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtctgggaagtgaaacatgaggaat

SEQ ID NO: 51784 - DNA, 430 bp, Homo sapiens
agttatattggaattataaatatttttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattacatgcctgattcatagtaaaatacctctaataaacactgttttatagaaaacctgacttc

SEQ ID NO: 51785 - DNA, 410 bp, Homo sapiens
  misc_feature 23, 24, 350, 373, 375: n = A,T,C or G
ttcgatgtttatcactcagtggnnttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattagggaattatttcagagacaatgttttctttttcaggtgagtagttgccgcgtaatatcattggagtacattctttatactggttgngaaattaatactagatattaagngnacaaatagatttagaaaacaataaaaaattgcatg

SEQ ID NO: 51786 - DNA, 460 bp, Homo sapiens
  misc_feature 22, 24: n = A,T,C or G
ggtcctgaaacgcgggctgcancngatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcgaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatgg

SEQ ID NO: 51787 - DNA, 190 bp, Homo sapiens
  misc_feature 24, 116, 171, 185: n = A,T,C or G
ggggggatttatttctgaaagaanaatatataaacagatcttctacatttatatttttaatcttctgttaaatacactttccgatattgccttgccttttgagctcttgctacagncgcctttgctactgctttaagagaatttacaggcattgataaagaacaagactgntttattaaaagctntattc

SEQ ID NO: 51788 - DNA, 190 bp, Homo sapiens
  misc_feature 24, 174: n = A,T,C or G
tcttttaaaaagagattaaaccgnaggtgattaaaagaccttgaaatccatgacgcagggagaattgcgtcatttaaagcctagttaacgcatttactaaacgcagacgaaaatggaaagattaattgggagtggtacggatgaaacaatttggagaagatagaagtttgaagnggaaaactggaagaca

SEQ ID NO: 51789 - DNA, 160 bp, Homo sapiens
  misc_feature 3, 160: n = A,T,C or G
tgntaaaagaagaaaaatgtaaaatgcagctagggccatgcttacaaggaaatgtgtaactttacatgtatatatcagaaaagtatatagctcaggaaataagaaagatttaaaaaacagcaaatcccaaaagaaagtagaagtaaatataaagaacgtn

SEQ ID NO: 51790 - DNA, 150 bp, Homo sapiens
aatgcaaatgtcacggctactctatatacttttgcttggttcattttttttcccttttagttaagcatgactttagatgggaagcctgtgtatcgtggagaaacaagagaccaactttttcattccctgcccccgatttcccagactaga

SEQ ID NO: 51791 - DNA, 200 bp, Homo sapiens
  misc_feature 9, 191, 193: n = A,T,C or G
ttataagcnttgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgngngtaaaat

SEQ ID NO: 51792 - DNA, 260 bp, Homo sapiens
  misc_feature 25, 177, 179, 209, 250, 258: n = A,T,C or G
cttcattaacaggagaaatgcaaanaccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctntnatcgctacttcaggaagcgccgagggaccnaatgagactgagggaagaaaaaaaatctctttttttctggnggctggcncc

SEQ ID NO: 51793 - DNA, 310 bp, Homo sapiens
  misc_feature 228, 246, 261: n = A,T,C or G
ccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgnctttcagcaaggactggnctttctatctcttgngctacactgaattcacccccactgaaaaagatgagtatgcctgccgcgt

SEQ ID NO: 51794 - DNA, 293 bp, Homo sapiens
  misc_feature 22, 193, 204: n = A,T,C or G
actattgctacttaaatttccnataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgntaatatctggnaagtatcttgagatatcagtggaaagctaaacagtctaaattaacatgaagtacttcattttgattgagaaaataaaatcagatttttt

SEQ ID NO: 51795 - DNA, 320 bp, Homo sapiens
ttcatctgcagtatcctcaccattaaaaaaagaacagcccttatttactctacggcaggttgggatgatctgtgaacgtttgttgaaagaacgtgaagagaaagttcgagaagaatatgaagaaatattgaacacaagacttgcagaacaatatgatgcgtttgtgaagtttacgcatgatcaaataatgcgaccgatatggagaacagcctgctagctatgtttcatgaatcacgtatcctgcatttgtgggctgccttgttccttgttgagttgtcgcaagaggtcccaattatgacatgcagcaatgccaatacccc

SEQ ID NO: 51796 - DNA, 320 bp, Homo sapiens
  misc_feature 241, 280, 282: n = A,T,C or G
cagcagagatggagagctaaagtccaagtagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtngcagcattactgaaatacataggcttatatacaatgctncntttcctgtatattctcttgtctggctgccccccttttt

SEQ ID NO: 51797 - DNA, 270 bp, Homo sapiens
  misc_feature 191, 195, 254: n = A,T,C or G
tgtagccattcataaactcaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtntganttaatgccaactgtatgcctttgagagtgaaatcagaataatgtctctccactaaagcnggacttagagcactag

SEQ ID NO: 51798 - DNA, 310 bp, Homo sapiens
ataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 51799 - DNA, 130 bp, Homo sapiens
  misc_feature 40, 42, 82, 101, 118: n = A,T,C or G
aataaagtcagatggaaaattcattttttaaattcccggntnggcactttttctgagaaaagatggccatattacccctttncggccccatgtatctcagnaccccatggagctgggntaaggaaatagg

SEQ ID NO: 51800 - DNA, 400 bp, Homo sapiens
aatgcagtggtagagttagtttctgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaat

SEQ ID NO: 51801 - DNA, 400 bp, Homo sapiens
  misc_feature 236, 281, 293, 344, 352, 388, 391: n = A,T,C or G
cagtatgtcctggggcctttttatgagtagctgcatttcttaaaaattgcctgtgatgaagtaaacgtgcatatataaatgattttcatgactaattttgattttaaatttggaaatacagttttatagtgggaaaacattggtacctgacacacaataaattttcacttacgattcctaatatttactttaaagagccattctgcttgtaactaggcagttttatatttcatagnctctgccagtgggttctaattttgggccacgaatgctggagaggnatatgaagttgntataagggatttgattatccaaatgaacccctatctgcagacctgatttgnactggggngtttcaggatgtatatagggatttggggctaatggnagnattatttaa

SEQ ID NO: 51802 - DNA, 480 bp, Homo sapiens
  misc_feature 17, 18, 27: n = A,T,C or G
tagtggaaacaacaagnngaacagcanggtaggcactcctagccctcccagacataggattatcagttggaacacccaaccctgcccagcaataacagagccattcctttcttagtgacaatggagacccagcagagaaactagatttttacccttacctggcagtaatgaggccccctccttgcttccatgctgaagcactgtcagaagaagccaactaaaatggaaggtttgaataagagccaaagtctccaaacataaaccccaaaatgtatatgttccagtcaatctttatacagagaaccagaaaaatctcaactggaatttttaaaaaatcaataatcatcaatagtgagatgacagatatgttaaattatttgacataattttttaaaaaccattataaaaatgcttcagtaagcaattactaacacatttgaaacaaatgaaaaaatgcaagctcagcaaagagctacaaac

SEQ ID NO: 51803 - DNA, 207 bp, Homo sapiens
  misc_feature 23, 25, 48, 63, 87: n = A,T,C or G
atggaaaaaaaataagtcttcanantaggtattctgggaatgatgtantgctctgaatttagnatgatataaagaaaacttttttgngctaaaaatactttttaaaatcaattttgttgattgtagtaatttctatttgcactgtgcctttcaactccagaagcattctgaagatgtacttggatttaattaaaaagttcactttgc

SEQ ID NO: 51804 - DNA, 351 bp, Homo sapiens
  misc_feature 6, 32, 327: n = A,T,C or G
caatanaagtaaatatagattatatatgtatngtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaaaanaaaaaaaaaaaaaaaaaaaaaaaa

SEQ ID NO: 51805 - DNA, 500 bp, Homo sapiens
  misc_feature 25, 364, 409, 420, 469, 477: n = A,T,C or G
cctacaaccagtattctcagagatnccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccggcttcagctcaactcacagcttctccaagcatcaccctgggagtttcctgagggttttctcataaatgagggctgcacattgcctgttctgcttcgaagtattcaataccgctcagnattttaaatgaagtgattctaagatttggtttgggatcaataggnaagcatatgcngccaaccaagatgcaaatgttttggaatgatatgaccaaaattttaagnaggaaagncacccaaacacttctgctttcac

SEQ ID NO: 51806 - DNA, 500 bp, Homo sapiens
  misc_feature 48, 270: n = A,T,C or G
attcctgagctgacagcattcgttccgagatgtctcgctccgtggccntagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggnctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaa

SEQ ID NO: 51807 - DNA, 470 bp, Homo sapiens
  misc_feature 23: n = A,T,C or G
ttcgctgcctgatcgccgccatnttgggtcgcatgcatgctcccgggaagggcctgtcccagtcggccttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccgggattcaccgtttggctcgatattataagaccaagcgagtcctccctcccaattggaaatatgaatcatctacagcctctgccct

SEQ ID NO: 51808 - DNA, 440 bp, Homo sapiens
  misc_feature 24, 223, 395, 421: n = A,T,C or G
ctatcttatttgactaagtggaangagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagngccacgtgaaacccatgacaaaatgaatgtgaatattctttctaaaaatttagaaaatgttatctttttgcatttattatgtaaaactggtttacagtatcaaaatttttcacttaaagaaaaaaaatgccatgaaacatttggaactgatgagccacagaacttcagttgnaatttttttcactttttagcatgctnaatatacatctgagtttaa

SEQ ID NO: 51809 - DNA, 350 bp, Homo sapiens
  misc_feature 305, 314, 334: n = A,T,C or G
agtcagttgtttataggtacttgtttaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcatagtatgtgtcacattataaagattcaggcaatgntgtggtagnattagtacttttttttcttnctaagtgcaaaagata

SEQ ID NO: 51810 - DNA, 500 bp, Homo sapiens
  misc_feature 34, 35, 331, 358, 448: n = A,T,C or G
cgggggaagccctgcctgaccgaccttcagcagnnctgtggctaccatgttctctcgcgcgggtgtcgctgggctgtcggcctggaccttgcagccgcaatggattcaagttcgaaatatggcaaccttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggngtgtcctcagatcgaggactgtgtggngctattcattcctccattgctaaacagatgaaaagcgaggttgctacactaacagcagctgggaaagaagttatgcttgttggaattggngacaaaatcagaggcatactttataggactcattctgaccagtttctggtgg

SEQ ID NO: 51811 - DNA, 276 bp, Homo sapiens
  misc_feature 17, 206, 237, 255: n = A,T,C or G
ttatggccaggtaatantaaacttttattcgtgtctacttgctgccagtttcatgaggctttctttaaacattaatactgactttaggctagcttaaatatattataaattctgatacagatttctctagtcatgtgcttcttagttatgatgtcaattcagaattttttatcagaattttgttctagaaaaaaaaaaagtcaacncacgtcactgctataaattatatcccagaangggggctaaaataaactngcaatatcttaaaaaaaaaaa

SEQ ID NO: 51812 - DNA, 290 bp, Homo sapiens
  misc_feature 17, 52, 68, 76, 115, 151, 206, 289: n = A,T,C or G
gaaagttgtctgctttntttatgccttaaaattcacctgtcagggaggcatnaaaaatttggaaatgnatgccatncaaaatgtgagctctgtattttttggcattcttatgttngggttcaataagattaagaaaatgatactgggaatnttctttttcctgaaactttgaatcaccctagtaagtcaaagtactaaaaaatgtnctagatcattaagacttatgcgctcttactgattgaaagattttttatgttttccttgtaataaaggacctaaaccgaaggtnc

SEQ ID NO: 51813 - DNA, 500 bp, Homo sapiens
  misc_feature 308: n = A,T,C or G
gtgtcaaaaagtaagtgaaattaaatagaggtttaagaggacaaatggaaaagatattatgtactaaattcatgttaagaagaaggatgaacaagacgcccattggcctggaagtaaggtggtgccattcagcaggacaagaattacaggaggaagggaaattgaataacgtatgaaattgaaacatgtaaaatctcatctcatctgctggtcaaggatatatactgaaggtagtgaggggaaaaacataacattaataaaacattaaatacaggggagcatttgagtctacagacacagatgaaggnggcatcaacagagagacagctattaatgtaacagaaagatgatattaactagggaaaattaagagtaagaagggagtgacaagcataaaccaggttagtagcacatttaaaagggcaggaaagcaaataaatatcatgaaatgccctaggaagaagtgacacagagacaggaaggaaaccaggcaacacaga

SEQ ID NO: 51814 - DNA, 400 bp, Homo sapiens
  misc_feature 24, 180: n = A,T,C or G
gagctccatttctattctcagtgncagtggagaccacatggtaattctggacttccaaagccatctggaagtaatagggtgctctttcttctcctgactgggctggtgtccgtggaggcctagacaatattcaggaccttcaccactgccctatgataacaaggccaccctcattacagngttccaactgggagttggaactcctagaattctcaccttcacccagcagtaataaggagcctcttcctaagatgctgaatggggaatctgggctttgcatccatgtggaaatcatgaggcagtaccacctgccccttcacctgccagagaagtgtcagagaaagccaattaaaacagaagatttaaataagaaatggcatctcttaacataatttaaaaa

SEQ ID NO: 51815 - DNA, 500 bp, Homo sapiens
actatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagtttatcagtttgcaggtcgaagtaagaaggaaaccaaatattctcttaaggctgtcgaagacatgttggaaacattgcagaccacccagtcttaaggtttcaaaaactctttgacattagatttcacaactgcacaattgaacttattggcctgtaacttatttactaaatgctcagtgctatttatatactacagtaattttctgtta

SEQ ID NO: 51816 - DNA, 410 bp, Homo sapiens
  misc_feature 274, 403: n = A,T,C or G
cgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggntggatcaagtttaaatgactgtgctgcccctttcacatcaaagaactactgacaacgaaggccgcgcctgcctttcccatctgtctatctatcaggcctggcagggaaggaaagaacttgcatgttggngaaggaa

SEQ ID NO: 51817 - DNA, 177 bp, Homo sapiens
  misc_feature 58: n = A,T,C or G
cgatgaccaccaatatatgcaatggtaagccattagatggactgactactttgcgcantgggacattagttgcattccgaggtcattatttctacgatgctaagtccattcagtccaccatctccagctcgcagaattactggagtttggggggattcctttgccccagttgatact

SEQ ID NO: 51818 - DNA, 280 bp, Homo sapiens
  misc_feature 16, 32, 156: n = A,T,C or G
ataaatgaactcaatntaaattaaaaaagaanagaaatttgaaaaaactttctctttgccatttcttcttcttcttttttaactgaaagctgaatccttccatttcttctgcacatctacttgcttaaattgtgggcaaaagagaaaaagaagggngggatcagagcattgtgcaatacagtttcattaactccttccctcgctcccccaaaaatttgaatttttttttcaacactcttacacctgttatggaaaatgtcaacctttgaaaaaaaaaaaa

SEQ ID NO: 51819 - DNA, 440 bp, Homo sapiens
  misc_feature 16, 41, 43: n = A,T,C or G
tatggccggggatggncgtcaaatgaaggtgaattcaaggntnaaggaaatagcaaattcacctacacagttctggaggatggttgacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaaatttaactccatatgtgttcctcttgttctaatcttgtcaacccagtacaagtgaccgacaaaattccagttatttatttccaaaatgtttggaaacagtataatttgacaaagaaaaatgatacttctcttttttttgctgttccccccaaatacaattcaaatgctttt

SEQ ID NO: 51820 - DNA, 143 bp, Homo sapiens
  misc_feature 21, 29, 37, 52, 121: n = A,T,C or G
cattatgtgtataccaaggcnagccaggnatacatgnttttcttgatgattngggttttaattttgtttttattgcacctgacaaaatacagttatctgatgggccctcaattatgttatnttaataaaataaattaaatttg

SEQ ID NO: 51821 - DNA, 500 bp, Homo sapiens
  misc_feature 24, 25: n = A,T,C or G
aggaaagaagaaaaagggccaaannccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaaatctgtgttaaacaagtagtaataaaaggttaatt

SEQ ID NO: 51822 - DNA, 400 bp, Homo sapiens
  misc_feature 205: n = A,T,C or G
catttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcnggaaaataataatgtttttaactaatgaaggctactggagttactaagaatcacctaaaaatgtgctactgtaccttgctcattttgcagatttagaagctgaaacatgggttaggttacttactaaaagtccacctgtggcaaccctgcaaataatgcttatttatactaaagatgagtttatctgatagagtt

SEQ ID NO: 51823 - DNA, 100 bp, Homo sapiens
  misc_feature 23, 38, 75, 84: n = A,T,C or G
ttcctggggatgttttgggtagnatcttggcatttgtnttgataggttaaaattcacttccaaataaataaaacncccatgatnctagatttgatggggc

SEQ ID NO: 51824 - DNA, 500 bp, Homo sapiens
  misc_feature 1, 176, 371, 372: n = A,T,C or G
nactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggnggggtaacagaaaggaactggctaccgttcgggctatttgcagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcaggnntcgggatgagaccaggtgttgctttgttcagtatctcaagcccagaaagatgaattaatccttgaagggaaatgacattgagcttgtttcaaattcagcggctttgatttcagcaagccacaacagtt

SEQ ID NO: 51825 - DNA, 310 bp, Homo sapiens
  misc_feature 12, 84, 158, 224: n = A,T,C or G
ccaactgttagnccaaagaggaacagctctttggacactaggaaaaaaccttgtagagagagtaaaaaatttaacacccatagnaggcctaaaagcagccaccaattaagaaagcgttcaagctcaacacccactacctaaaaaatcccaaacatatnactgaactcctcacacccaattggaccaatctatcaccctatagaagaactaatgttagtataagnaacatgaaaacattctcctccgcataagcctgcgtcagattaaaacactgaactgacaattaacagcccaatatctacaatcaacc

SEQ ID NO: 51826 - DNA, 554 bp, Homo sapiens
  misc_feature 56, 157, 171, 183, 184, 186, 194, 199, 202, 210, 218, 219,220, 223, 232, 233, 234, 240, 241, 246, 247, 253, 255, 256,263, 266, 267, 269, 272, 275, 276, 280, 281, 284, 287, 288,289, 290, 291, 292, 293, 295, 299, 304, 309, 310, 311: n = A,T,C or G
  misc_feature 312, 313, 314, 315, 316, 317, 325, 330, 332, 333, 334, 340,341, 342, 343, 345, 352, 360, 364, 373, 374, 376, 380, 381,395, 399, 402, 412, 415, 432, 433, 434, 435, 436, 437, 449,457, 477, 478, 480, 494, 503, 507, 510, 512, 527, 528: n = A,T,C or G
  misc_feature 531, 532, 535, 537: n = A,T,C or G
ggaggcaagagtgagggttccaacttttctgcttatctgggaggtgttgggcgcgncagtcgagatgtcagagaaaaagcagccggtagacttaggtctgttagaggaagacgacgagtttgaagagttccctgccgaagaacttgggctggcttanaaaaaaaaaaaaancccccccccctnngnctgggggnggganttntttggganggaccccnnnggnggggggggnnnttcttnnttatnntccgcncnncgggcgngcnngnaanaannaaannacnggnnnnnnngngggnggggnccccnnnnnnnnnagcccccnaaaanannngggggnnnngnaaggaanccctaaancttnggcccgggnntnaaannaatttcttgggggngggnganaacccccgcnggnggggggcccaaaaatannnnnnaggggggggggnttttttcnttttttttcgcgcggggggnntnattttttggggggntttgggggnaccnccnanaaaaaaaaaagaggnnttnnggngnaaaaaaaaaaaaaaaaa

SEQ ID NO: 51827 - DNA, 450 bp, Homo sapiens
  misc_feature 58, 80: n = A,T,C or G
agttctttgcaagaaggtagagatcaagacactttttcaaaaatggcaatggtatcangaattcctcaagcaggcctggnttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagccctggatgaaacactgaagaaagcccttacaggtcaccttgaggaggttgttttagctctgctaaaaactccagcgcaatttgatgctgatgaacttcgtgctgccatgaagggccttggaactgatgaagatact

SEQ ID NO: 51828 - DNA, 500 bp, Homo sapiens
gggatgggtgctctttggctggccttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttattttctttcaacaaatataa

SEQ ID NO: 51829 - DNA, 152 bp, Homo sapiens
  misc_feature 17, 31, 42: n = A,T,C or G
tatggccgggtcatcanagcagtggacaagnaaggctgctgntgctggcaaggtcaccaagtctgcccagaaagctcagaaggctaaatgaatattatccctaatacctgccaccccactcttaatcagtggtggaagaacggtctcagaac

SEQ ID NO: 51830 - DNA, 270 bp, Homo sapiens
  misc_feature 25, 66, 73, 99, 146, 235, 258, 260: n = A,T,C or G
gaccaaaattttaagtaggaaagtnacccaaacacttctgctttcacttaagtgtctggcccgcantactgtnggaacagagcatgatcttggtactgngatattttaaatatccacagtactcactttttccaaatgatcctagnaattgcctagaaatatctttctcttacctgttatttatcaatttttcccagtatttttatacggaaaaaattgaattgaaaacacttantatgcaggtgataagaggaattngntataattatg

SEQ ID NO: 51831 - DNA, 170 bp, Homo sapiens
  misc_feature 24, 101, 106: n = A,T,C or G
ccagctgcatgggaaagcaaagcngaaaacagtgccccaaatggaaaaaaaggatacttcacacaggaaacaaaaacagttcttgggccttggtcttgggncttgncaaaccttgcctgatgctttttctaaaggtcaaaatatgaatgctaagaaggcataaccctaca

SEQ ID NO: 51832 - DNA, 140 bp, Homo sapiens
aacagcgaaaggtataaagtaagatgaaaatttccatcatgatcttacctaggagataacttctctttttttgagtcggagtatcgctctcgttgcctaggctggagtgcagtggcgtgatctcggctcactgcaacctc

SEQ ID NO: 51833 - DNA, 500 bp, Homo sapiens
  misc_feature 4, 480, 495: n = A,T,C or G
tagnattcccagggaaatgggcagtctgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaaccctgggcatcttaggaagcagtccctggagaaggcatgttcccagaaaggtctctgggagggacaaacctcactcagtaaaacataatgtatcatcatgaagaaaactgattctctatgacatgaaatgaaaattttaaatgcattgntataattactaatgnacgcc

SEQ ID NO: 51834 - DNA, 500 bp, Homo sapiens
  misc_feature 15, 22: n = A,T,C or G
atggccggggttcanttcaagnaagcatttattgaaccgttctcatgagccaggtcagggtgttcacgcactgagcgtgtcaagacgaagacacatagcctctaagtgtccaccatctacaatagctaatgtttaattgtccttaaaagttgaagaatgttgactggattgtctgcaaatcagtcatgtgagtagtgttaatctaatgaagaagaatcttaaaagacaaattctccaaatgctgctgctcctgcatcctgctgctctacctgctgtggggaggagtgaccactccctgatatgctgcagatgcaattgagtagcagcttcattccacatttctccaacatctttcatggtgaggtcaagagcatattcaaaaccatgtgtggctcagtccaactggagagaccaagtcaaagagcctcatttccataaggcacagagttaagaagtggcaagttaacacagccagagcatgcacagaagaaaacttcgac

SEQ ID NO: 51835 - DNA, 350 bp, Homo sapiens
  misc_feature 19, 32, 79, 91, 125, 135, 182, 265, 333: n = A,T,C or G
aaggccagttgtggttgantcctgcctgaaancccactactttgggaggctgaggctggagaatcgcttgaggctatgngacgctgtgatnagtaccactgcactccagctcggggaacagagcnagaccttgtntctaaaaataatagtaataaaataaaaataacgttttatgactattnattgcaaggtcaagagttacagattgttataaattggtgagaaatttttgtgattagaatatgaaggaaaaagctttgttggnaaaagtgacatgttaaggggctatgaagtaaatatgctgcaggtaattgtgctaagctaaaatacagnttagttatttgctttaa

SEQ ID NO: 51836 - DNA, 500 bp, Homo sapiens
  misc_feature 42: n = A,T,C or G
tatggccgggggttctattcaaaggaaaagctaaagcaaaancactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggcgttttaagatcactgagtgtccagaagagagaaattcaaacaaaatattgctgttcttcagttttgtttgtggaatttgaaattactcaaatttaaaataaattac

SEQ ID NO: 51837 - DNA, 400 bp, Homo sapiens
  misc_feature 49, 50, 96, 101, 110, 120, 121, 179, 184, 262: n = A,T,C or G
actaaagaaagtcatgtgttctcgaaagaaagtgaagcaagcaggatannagacatttttagacctagacttaccatagtgaaacataagaatgtnaggcnttaaaaaanttataaaagnntcagggagaacgttagcatccctataaaggaaaaataatgagatgatagttgatttgncatcnacaataatagaagccaggagaaaaaatagttgtcaacctaaaattatatgcccagcaaaattactgctgaagactcangtcaaaacaaaaacaatctttgatatgaaaagaataagaaaggttactactcactgacatatcataaataattactaaagacatcccatcaacaaggaaaaaaactgaaatcagagggagagcacgggataggaaaaa

SEQ ID NO: 51838 - DNA, 370 bp, Homo sapiens
ttatggccgggggtttcttgctgcagcaacgcgagtgggatcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaaagctgcacttgtgaacctgggcactccgcgccgatgccaccggccttgtgggtct

SEQ ID NO: 51839 - DNA, 274 bp, Homo sapiens
  misc_feature 22, 24: n = A,T,C or G
ctggagagaggttggggaggancngaatggacacagcgtggttctggtcccacagaggtcctattgtctgtaagaatttgatgttggctaaaagagacatcaggagtcactggggagggagaaattatgctgtaatggtcagggaaagtggttagactttttcaaaaacaaacaaaatgtaaaattttacatcttcactttaccctatatagccaacttaaactccaagatagatctaacagtaactctttttgtaaaaaaaaaaaaaaaaaaa

SEQ ID NO: 51840 - DNA, 252 bp, Homo sapiens
  misc_feature 17, 131, 202: n = A,T,C or G
atgtgttcctcttggtntaatccttgtcaaccagtgcaagtgaccgacaaaattccagttatttatttccaaaatgtttggaaacagtataatttgacaaagaaaaatgatacttctctttttttgctgtnccaccaaatacaattcaaatgctttttggtttatttttttaccaattccaatttcaaaatgtctcaatggngctataataaataaacttcaacactctttatgataacaaaaaaaaaaaaa

SEQ ID NO: 51841 - DNA, 390 bp, Homo sapiens
  misc_feature 8, 15, 24, 27, 38, 42, 50, 55, 62, 63, 64, 65, 72, 73, 75,76, 80, 86, 89, 91, 101, 107, 111, 117, 120, 126, 138, 144,145, 147, 157, 162, 172, 173, 177, 178, 179, 185, 186, 197,204, 215, 221, 225, 229, 230, 232, 233, 234, 238, 240: n = A,T,C or G
  misc_feature 242, 243, 247, 251, 269, 280, 285, 288, 298, 303: n = A,T,C or G
cttcttgncccagancccctctcnctnttatggccggnaagnccccgagntgacncaagacnnnntgttttnnanncgtnccatanggngnacgcccatgnaccctnccanatgggngcnttatangagtcatgccangtgagnncntgtgcacctnacctngtcccttatnncgannnggaggnngacacttacantaataanatgcattcccngagcangcanattnntnnntggnanannttgnaaanagagaagagcaccaactncttattgccgngtccnccnacagagaganctganaccacagacttgccagcttggctgcgaaagaaaggaaccgcactgctatggactacctcgctttcctgagctaccgagagcgctcgt

SEQ ID NO: 51842 - DNA, 181 bp, Homo sapiens
  misc_feature 26: n = A,T,C or G
tgagaaatatttacttaatctagggncacaaagattatcttctatgttttctcctgaaggttttatagtttaaagttttacattgaagtctattatctattttgagtgaatattttgatatagtgtgatatatgaatggaggttcattttaaaaataaatatccaattattcaaaaaaaaa

SEQ ID NO: 51843 - DNA, 294 bp, Homo sapiens
  misc_feature 128, 292: n = A,T,C or G
tcagaggcccgtgaagatatggctgcccttgagaaggattatgaggaggttggtgtggattctgttgaaggagagggtgaggaagaaggagaggaatactaattatccattccttttggccctgcagnatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaaaaaaaaaaaaaaanaa

SEQ ID NO: 51844 - DNA, 170 bp, Homo sapiens
  misc_feature 42, 52, 54, 86, 112, 117, 158: n = A,T,C or G
agtcactctcccagagaaaatgatttcatatacattgagggncttacaaggnanggggaaagttctataaattgcaacaaaatganacccaatttcattttatcctttttgnattgngaaactggaaaactttatgacattgtaaattatcagctggnttttctgaatat

SEQ ID NO: 51845 - DNA, 400 bp, Homo sapiens
  misc_feature 15, 19, 22, 172, 174: n = A,T,C or G
tctgtttggtgcttngganccntttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgnanaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaa

SEQ ID NO: 51846 - DNA, 400 bp, Homo sapiens
  misc_feature 111, 130, 132, 183, 215, 245, 262, 294, 397: n = A,T,C or G
atgccttttgtctcatcccttgcttttaagtattattataagacttttggagactcacgaaacaagcaatccctaaattctcgcccagggaagtatcttggattaaatggnttttgagaaccttgagagngnatattctatgaaatggaagaaacaagaactagacagagtcacaaatgctgntgatcacagacaatctctgccatccataaggnaaatgtaatacatctggcgacctgctgagngtgaacttgcagcaggngaggaaggaactctgaactctcacaatcttgnttcttcatttcccagagagaaactcggcaaagagaaaaaggacatttccctccagggtatctgaaagaatttcaatgcttaccctttaatcatgggacattgntta

SEQ ID NO: 51847 - DNA, 250 bp, Homo sapiens
  misc_feature 87, 126, 127, 151, 153, 155, 217: n = A,T,C or G
ggcgcaatagatatagtaccgcaagggaaagatgaaaaattataaccaagcataatatagcaaggactggcccctataccttctgcntaatgaattaactagaaataactttgcaaggagagccanngctaagacccccgaaaccagacgngngncctaagaacagctaaaagagcacacccggctatgtagcaaaatagtgggaagatttataggnagaggcgacaaacctaccgagcctggtgatagc

SEQ ID NO: 51848 - DNA, 150 bp, Homo sapiens
  misc_feature 16, 37, 69, 84: n = A,T,C or G
actctggtgccgaccngaaagccgaggctggggctgngtcatgcaaccgaattccagtttagaggcggntttggtcgtggacgnggtcatgccacctcagtaaaattggagaggattcttttgcattgaataaacttacagccaaaaaac

SEQ ID NO: 51849 - DNA, 500 bp, Homo sapiens
  misc_feature 125, 153, 155, 203, 339, 474, 498: n = A,T,C or G
ttttatctgtataattttttttgtcagatattctggggttaaaggcacatcatatgtgaggaggaaaagtttaacatgaactaacatttctgcactgtaacgtgccgggcacacactaaactcanttactgtacctacagggaagtctacatncnctctgacagccacagcactacatcaatccctgacgttagggatacctnatgacattttcctgtttttatggaaactctgagaagctgaatgatacatgcaggggatattttttgagatgatttaaatgtaaaccaaaagagggaagacaaaaagacaaacacacccacacgcagcctttgcagnatctgcaagagaaactcacaggaaggtacttcaagcacttgccaggactatgatattcaaggaccttgcagcatttctctgccattgctttcaatgaggccagaggcatcctggatattagacctattatactgnaagaatataagtataaagggcggnca

SEQ ID NO: 51850 - DNA, 400 bp, Homo sapiens
  misc_feature 9, 54, 61, 66, 81, 148, 350: n = A,T,C or G
aatccaagnttgctgacctctctgaggctgccaaccggaacaatgacgccctgngccaggnaaagngggagtccactgagnaccggagacaggtgcacgtccctcacctgggaagtggatgcccttaaaggaaccaatgagtccctgnaacgccagatgcgtgaaatggaagagaactttgccggtgaagctgctaactaccaagacactattggccgcctgcaggatgagattcagaatatgaaggaggaaatggctcgtcaccttcgggaataccaagacctgctcaatgttaagatggcccttgacattgagattgccacctacaggaagctgctggaaggcgaggnagagcaggatttctctgccttttccaaacttttcctccctgaacctgagg

SEQ ID NO: 51851 - DNA, 110 bp, Homo sapiens
ttcattgccatcagtgatctcactaaaaatatacagctacttcccagctaatctccacccaatgaatgatgatggtatagtatgtgcataatggaaagttaccttactga

SEQ ID NO: 51852 - DNA, 170 bp, Homo sapiens
  misc_feature 120, 138, 153, 155: n = A,T,C or G
gtaaagtccttaaaacaccaagagataagaagcaaatagcatataacagagctccaaatcgtctggcaacagccttctcaacaggccagtaggtattggaacattttaaaaaaaaactgncatctagggaatatttgnggccagcaaaattgncnattcaaatatgaagg

SEQ ID NO: 51853 - DNA, 147 bp, Homo sapiens
  misc_feature 1, 25, 50, 85, 114, 117, 132: n = A,T,C or G
naactgctgtattatacattgtgtnattgaataaacagcctaatttttcntttctagtatagggtacttaagcatttccactttnggaagaaaagggtattagtattttatatngcntttcatttaaaaggncagtttttttttttt

SEQ ID NO: 51854 - DNA, 220 bp, Homo sapiens
  misc_feature 218: n = A,T,C or G
atttcaagcggttctgagacatcttctgagggctttacttcctgagaggcaaggtttttactttatgcataattcattggggccaaggaataacgggaagaaacagcacctttaaatatataggtctttttggaagagacctaaattagaaagagaaaactgggacaattttcatattctcattcttaaaaaacactaatcttaactaacaaaagttntt

SEQ ID NO: 51855 - DNA, 460 bp, Homo sapiens
  misc_feature 40: n = A,T,C or G
tatggccgggggtacggagaatacttgaacccaggaggtnaagggtgcagggagttgagccaagcatcgcgccattgcaccctagcctgggcaacagagcgagattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatggtgcgatcggtctatagatgtgtcatggaaacttggttgcaacttcaagacaaaataaaaagtaaacatttacatgaaaatggtggatatggaaggtggagaagagaggagataacagctttatctttcaaaatagagaattgagagatggtaccaaaagctgatgaa

SEQ ID NO: 51856 - DNA, 450 bp, Homo sapiens
ggccgcgttcgcaccaaaaccgcgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 51857 - DNA, 298 bp, Homo sapiens
  misc_feature 241, 252: n = A,T,C or G
agtaatggtccagcgtttgacataccgacgtaggctttcctacaatacggcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggngggttccatgngtgctaaatgtgttcgtgacaggatcaagcggtgctttcctttatc

SEQ ID NO: 51858 - DNA, 100 bp, Homo sapiens
  misc_feature 23: n = A,T,C or G
cacgcagcacctgcagcatcagnagaatcgtacatttctgttctaaagcgcgtttggtcatggagggagcagtccggcttccagagtcaggatcacaggc

SEQ ID NO: 51859 - DNA, 300 bp, Homo sapiens
  misc_feature 39: n = A,T,C or G
aattcttattgttttgaggttactttcctttgatgcctnatagttttttaagggtttttgccatgaagggatgttgaattttattgaaagcattttctgtgtctatcgagatgatcatgtggttttgtttttagttctatttatgtgatgaattacatgcattgatttccatatattgaaccaaccttggatcctaggaataaagcccacttgatcacagtgggttggctttttgatgtgttgctgggttttggttcataaaaggcagttcccctgcacacactgttgcctattacccag

SEQ ID NO: 51860 - DNA, 124 bp, Homo sapiens
  misc_feature 35, 36: n = A,T,C or G
atttgtaagtgttcagtttctacacaactttattnntccgctaagaatttaaaaatcacattctctgttcagctgttaatgctgggatccatatttagttttataagcttttccctgtttttag

SEQ ID NO: 51861 - DNA, 310 bp, Homo sapiens
  misc_feature 22, 204, 257, 283, 288: n = A,T,C or G
ggagatgatcagacttcctgantaggagaaagcttatgtgctttgttacattggggaacaactgaagagattcttgactcaaccttttagagcttagtccatgttgcaacgaggagtgttggttttgtttttccacttaaaaactttatttataaaaaggaaaagtagttttcatattaagtttttatttcctttccagcaggntggggctagaaagtatgtgttggcactagaaacattgtcaagatttgttctgnggtgtaggtatgcacattccataggnatgcncacggccatgtaatatcagtat

SEQ ID NO: 51862 - DNA, 300 bp, Homo sapiens
  misc_feature 23, 160, 215, 265, 298: n = A,T,C or G
atagtggaatacctggaaattcnttcaatgtgtcatccctggttgagctggatctgtcctataacaagcttaaaaacataccaactgtcaatgaaaaccttgaaaactattacctgggaggtcaatcaacttgagaagtttgacataaagagcttctgcnagatcctggggccattatcctactccaagatcaagcatttgcgtttggatggcantcgcatctcagaaaccagtcttccaccggatatgatgaatgtctacgtgntgctaacgaagccactcttaattaatatctgtntc

SEQ ID NO: 51863 - DNA, 270 bp, Homo sapiens
agcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccaggacttgaaagagggct

SEQ ID NO: 51864 - DNA, 248 bp, Homo sapiens
  misc_feature 24, 26, 75, 142: n = A,T,C or G
ggcgcggtaatgtgccttcagaananatattaatgcaagaccacatatgtcaacctgtgtctgctgctgactggnccaaggatattcgaacttgcaagattttaaatgcgcagtctttgaatacctggttgattttatgtancgacagaactgaatatgttgcccgagagctttctgaactgcttgagaagagttgcaggttccatgggatttaatgtggactaccccaaaatcataaaagtacaaga

SEQ ID NO: 51865 - DNA, 250 bp, Homo sapiens
  misc_feature 38, 114, 212, 229: n = A,T,C or G
aatgaaacacaagaaattggccgctggtaaaactctgnagcttcaactgtacttcatttaatgccattaatgcaaatatacttcctcttctttttgcatggttttgcccacctntgcaatagtgataatctgatgctgaagatcaaataaccaatataaaagcatatttcttggccttgctccacaggacataggcaagccttgatcatagntcatacatataaatggnggggaaataaagaaataaaac

SEQ ID NO: 51866 - DNA, 320 bp, Homo sapiens
  misc_feature 26, 28, 143, 178, 180, 240, 252, 300: n = A,T,C or G
cgggttttttttccttttcttacggntnggaggggccctcactccagctttgtgcaccctaggcagaagcaggactgtagacttcttttcagccctgtcttgtacctcagccttcggaggtcacttatacctctggttctggnggattctttgttctgtagttgtaactgatttgctngntgatggctcttcagctccctgttcttgcttgcttctagcatttaggagaattgagaaagntatgagcttagngctctgtccctcttccaaaattttttttaacattttacatctcctggnggcgccaccatttttaactg

SEQ ID NO: 51867 - DNA, 230 bp, Homo sapiens
  misc_feature 38, 158, 161: n = A,T,C or G
ctaaatatgaaagattcatcaggccaatgggcttgcgnttcaagaaagcccatgtaacacatcctgaactgaaagccaccttttgcctaccaatacttggggtaaagaagaatccctcatccccactgtatacaactttgggtgttattaccaagggnacntgtctttgaagtaaatgtgagcgaattgggccttgtggcgcaaggaggcaaagttatttggggaaaata

SEQ ID NO: 51868 - DNA, 320 bp, Homo sapiens
  misc_feature 264, 288, 289: n = A,T,C or G
gaagtattcaataccgctcagcattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcgatactgtaggaacaagcatgatcttgttactgtgatattttaaatatccacagtactcactttttccaaatgatcctagtaattgccntaggaatatctttctcttacctgnnatttatcaatttttcccagtatttttatacc

SEQ ID NO: 51869 - DNA, 250 bp, Homo sapiens
  misc_feature 26, 217, 249: n = A,T,C or G
ggaaggaaaaatgacctgaactcagngcgtactgcacagtacagccaataatttttgttctttgttttcacccccaccctcactggaattctcaccaaaaatagtttgatacttaaaaaacagaagtaaatacttttctcaatattgttttggctatgcaaaatatttgttttgcttaatgtcctccatttacacttctcagcaaatgtaagttgcnaacaaatgctttctttttatttttcccttggnt

SEQ ID NO: 51870 - DNA, 150 bp, Homo sapiens
  misc_feature 25: n = A,T,C or G
tccctctggttgatacccactacanaaaggacacttctgattaagacggttgaaactagagatggacaggttatcaacgaaacttctcagcatcacgatgaccttgaataaaaattgcacatactcagtgcagcaatatattaccagcat

SEQ ID NO: 51871 - DNA, 400 bp, Homo sapiens
  misc_feature 22, 25, 178, 363: n = A,T,C or G
gaatttctgtaaaaaaactgtnccntgcaaatccaacattgagcttctggactacgctgactccactgctgaatcctcaatggaaagggtcgactggttgcatgttgagatgacctgaaatgtagcctctgtccttgtaagtcagttgacttgccgcacatctctttgtgtacttgtncgggactggcagaaaagtcatttttcaaaagccataggcttttccttgcccttagctgtaataatgcatctgattttgatttcctccagaactgtgtttctgtccatcacctgtgtattgggccctgtgtttaccactctggcccactcctcacccccttgctcccctgggcttctggagtttgngacattgatttgaaatggatggtgttctcttgagagc

SEQ ID NO: 51872 - DNA, 370 bp, Homo sapiens
  misc_feature 33, 75, 181, 182, 329, 367: n = A,T,C or G
gtattcaataccgctcagtattttaaatgaagngattctaagatttggtttgggatcaataggaaagcatatgcngcccaaccaagatgcaaatgttttgaaatgatatgaccaaaattttaagtaggaaagtcacccaaacacttctgctttcacttaagtgtctggcccgcaatactgnnggaacaagcatgatcttgttactgtgatattttaaatatccacagtactcactttttccaaatgatcctagtaattgcctagaaatatctttctcttacctgttatttatcaatttttcccagtatttttatacggaaaaaattgtnttgaaaacacttagtatgcagttgataagaggaatttnggt

SEQ ID NO: 51873 - DNA, 160 bp, Homo sapiens
  misc_feature 24, 25, 49, 136, 151: n = A,T,C or G
agttattagagaggaagaagcatnncgcttgaagcactacaggaggaangcaccacggcagctctccgccaacttctctcagatttccacagagactgtttgaatgttttcaaaaccaagtatcacactttaatgnacatgggccgcaccntaatgagat

SEQ ID NO: 51874 - DNA, 291 bp, Homo sapiens
atccgatcttcctagcaaaaaatatctcttatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccaccctgcctgaaaaaaaaaaaaaaaaa

SEQ ID NO: 51875 - DNA, 210 bp, Homo sapiens
  misc_feature 134: n = A,T,C or G
caatgcagctcaaaacgcttagcctagccacacccccacgggaaacagcagtgattaacctttagcaataaacgaaagtttaactaagctatactaaccccagggttggtcaatttcgtgccagccaccgcggncacacgattaacccaagtcaatagaagccggcgtaaagagtgttttagatcaccccctcccccaaaaaaaaaaaaa

SEQ ID NO: 51876 - DNA, 209 bp, Homo sapiens
cagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttgctttggctgcgaaaaaaaaaaaaaaaaaaaaaaaaaaa

SEQ ID NO: 51877 - DNA, 233 bp, Homo sapiens
gaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacccaaaaaaaaaaaaaaa

SEQ ID NO: 51878 - DNA, 330 bp, Homo sapiens
  misc_feature 87, 129, 191: n = A,T,C or G
gggcattatccgctccctgaatgcccatgtgagtggagccctgctgatctgggagtacaccaggcagcagctgctctcgcacggagnataccaagccatgatgtgccttccttagtgaactgctgctgntgttcagacttttttaaaaaaaaactatttggactaaagaaacagattctgaaatttattgngataatttgtatttcttttttcttgcaatttaatgccaaaagtttgccatgtgccttaaacatattactatttattttcccctttaataaacactttttgttaaattgtattcttcctttaataaaatattttaagcaa

SEQ ID NO: 51879 - DNA, 170 bp, Homo sapiens
  misc_feature 23, 51, 166: n = A,T,C or G
ggcgaaaccccctctctactaanatacaaaaaattagccggacgtgatggngcacgccctgtatgtctcagctacttgggaggctgaggaaggggaatcgcttgaacctgggaggcggaggttgcatgtgagccgagatcgcgccactgcagcctggcgacagagngaga

SEQ ID NO: 51880 - DNA, 400 bp, Homo sapiens
  misc_feature 17, 24, 27, 179, 180, 183, 369: n = A,T,C or G
ggctgaggatttttggnccgcacnctnctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcnncgnaaaatccttggaaaaggtgtgtgctgacttgataagaggcgcaaaagaaaagaatctcaaagtgaaaggaccagttcgaatgcctaccaagactttgagaatcactacaagaaaaactccttgtggggaaggttctaagacgtgggatcgtttccagatgagaattcacaagcgactcattgactngcacagtccttctgagattgttaagcagatt

SEQ ID NO: 51881 - DNA, 275 bp, Homo sapiens
  misc_feature 25, 54, 206, 259: n = A,T,C or G
agctcacacaatgaaggccatattnaataagccatagctaacatcatactcagnggtgaaaaactgaaagcttttcttcccagattagcaaagaagaatgctgactctcaccatttatatttaatataattctggaactcctagccacagcaattagccaagaaaaataaattggcatccgaatcagaaaggaagagatgcaatgntgtctgtttgcagatacattatgtatattaaaaaaaaaacactaaagacactnccaaaaaaaaaaaaaa

SEQ ID NO: 51882 - DNA, 450 bp, Homo sapiens
  misc_feature 379: n = A,T,C or G
gctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggntaatgataacaatgcatcgtaaaaccttcagaaggaaaggagaatgttttggggaccactttggttttctt

SEQ ID NO: 51883 - DNA, 440 bp, Homo sapiens
  misc_feature 115: n = A,T,C or G
gcagtctattaacatcacggagctgaatctgccgcagctagaaatgctcaagaaccagctggaccaggaagtggagttcttgtccacgtccattgctcagctcaaagtggtacangaccaagtgtttgtcttcattgctttcacagggaaagaattactcgtcccactgacgagttctatgtatgtccctgggaagctgcatgatgtggaacacgtgctcatcgatgtgggaactgggtactatgtaagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagag

SEQ ID NO: 51884 - DNA, 100 bp, Homo sapiens
  misc_feature 17, 66: n = A,T,C or G
ctgaagaacagaactanaaagaaacctacccccaaaccaccagttgtagatgaagctggaagtggnttggacaatggtgacttcaaggtcacaactcctg

SEQ ID NO: 51885 - DNA, 390 bp, Homo sapiens
  misc_feature 372: n = A,T,C or G
atcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcattttttacaactctgctctacttagcctttggatttagaagtaaaaataaagnatctctgactttctgtta

SEQ ID NO: 51886 - DNA, 400 bp, Homo sapiens
  misc_feature 16, 59, 396: n = A,T,C or G
ctgcacattgcctgcnctgcttcgaagtattcaataccgctcagtattttaaatgaagngattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttataccggaaaaaattgtattgaaaacacttagtatgcaggttgataagaggaatttggnataa

SEQ ID NO: 51887 - DNA, 113 bp, Homo sapiens
  misc_feature 52: n = A,T,C or G
caagaaagcaagtgctatgtggcgataaaaaaagttttaatgtattggagangttttaaaaaacccagaaaaacgccttttttttttaataaagaagaattttaaaaaaaaaa

SEQ ID NO: 51888 - DNA, 390 bp, Homo sapiens
  misc_feature 14, 162: n = A,T,C or G
cctgctgtgcacgnaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtncagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagccttcttcgccttcgtcaaatcttcaatggaacctttgtgaagctcaacaaggcttcgattaacatgctgaggattgtagagccatatattg

SEQ ID NO: 51889 - DNA, 329 bp, Homo sapiens
  misc_feature 24: n = A,T,C or G
gcggaatttgcggctttggcagancgaaatcatggcaggtccagaaagtgatgcgcaataccagttcactggtattaaaaaatatttcaactcttatactctcacaggtagaatgaactgtgtactggccacatatggaaacattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaaa

SEQ ID NO: 51890 - DNA, 467 bp, Homo sapiens
  misc_feature 1, 8, 9, 16, 17, 19, 30, 45, 46, 50, 73, 102, 256, 341, 356,357, 359, 360, 365, 366, 367, 369, 371, 373, 376, 377, 381,402, 403, 408, 411, 414, 423, 428, 429, 430, 431, 432, 433,440, 442, 444, 445, 448, 452, 459, 460: n = A,T,C or G
nttttttnnccagagnnancccggtttttntggcggggaaacaanncccnaacataacatactatctaattantttttatattaaagccacttccaggcgcnactaatatttgatgatagataccagaacagtggctgcttagagtgagggcagggaattcaaattgaatggaaaaggggcctgaggaaattttctggggtgattgaaatgttttgtattttgatctggatgatggttatgtagctgcatatattngtcaacattcctcatgctgtatgtttagatttgtgattttactatatgtaaattaattccttaataaaatactattataaaatanaaaaaaaaaaaaaannannaaaannnangnanaannaaanaaaaaaaaaaaaaaaaaaaannaaaanttnggnggcgcgccnccccnnnnnnttttttnanannaanaaantttttgnncgggcgg

SEQ ID NO: 51891 - DNA, 400 bp, Homo sapiens
  misc_feature 21, 33, 116, 387: n = A,T,C or G
cttacacaatgttgcacaagnaagaagctgcanttcagagtttttatcaaacttatttttgtgatattctccagcatatcttttctgttgtgacagacacttcacatactgctggnttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacaggggcttttcagcttaaaatcaagatattcctgctttcaaggaacattttaagagatttcctagttcaaataaaggaatttgcagggngaagacacttctg

SEQ ID NO: 51892 - DNA, 330 bp, Homo sapiens
  misc_feature 118, 188, 191, 197, 282: n = A,T,C or G
ggacgatttcttcccgggttccgatcgctttgcccggccggacttcagggacatttccaaatggaacaaccgcgtagtgagcaaccctgctctattaccagaccaactacctggtggnggctgccattgatgatttccattgtggggtttctgaggcccttcaacatgatcctgggaggaatcgtggnggngctggngttcacagggtttgtgtgggcagcccacaataaagacgtccttcgccggatgaagaagccgctaccccacgacgttcgttatggnggtcatgttggcgagctatttccttatctccatgtttggaggagcatg

SEQ ID NO: 51893 - DNA, 500 bp, Homo sapiens
  misc_feature 21, 333, 443: n = A,T,C or G
ggcggtgttgtaggtagcggnaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccactttcaaaatcagacctctgtggcagcattttttccagaacacaaaagagctatcagcttcccagnttgcacaattcatcaagaaattatgcggggtcacttggcacaaatgatgaggcatctcctggaagcttaaacttcttatccatcccatctcttggacagatgatgccagntaattactttgaatgctcctccaccaagccaaggccagactcctgcaatcataggat

SEQ ID NO: 51894 - DNA, 149 bp, Homo sapiens
  misc_feature 24, 26: n = A,T,C or G
gaattttgtgtgtactgattattncngctcaatactatgtctttaagattctctgtattgttgcatgtggctgagtttatttttgatgctgtgtagtgttttactaattaataaatcataattcagtttttactgttaaaaaaaaaaaa

SEQ ID NO: 51895 - DNA, 140 bp, Homo sapiens
  misc_feature 19, 26, 61, 64, 96: n = A,T,C or G
aattaccaagcatataggnttggggnacaaggggcatgggccccgattacagagggcttgngancagagctcgaaaactagctcaacaatactatnttggggaccaagaacccattcctacagcttagttggacagagag

SEQ ID NO: 51896 - DNA, 300 bp, Homo sapiens
  misc_feature 24, 239: n = A,T,C or G
ctggtagctttgcagacctttagntggggattcatattaatcagaaactttcccctcctctactgtcctacccttaataagttattgtttttcagaaagaagttctgtatttttagggacaagtattatttttcttgaatgtattgttccaagagcataaattatttaaatctcttaaacaagtttaagtttgcaatgaatattttgtggctaacataatggttgaaatgtagtcttgntttattgaagtttttcattgggtattgaaaacataaaatattgcctcattctctatagata

SEQ ID NO: 51897 - DNA, 150 bp, Homo sapiens
  misc_feature 23, 68, 88, 112, 149: n = A,T,C or G
gtgtagtaattgtgggactttcngggttggagcacttacaaggctgtgggagaatcataccccatggntaccacatattaaaccatgngtatctggggaatactcaatgtgnacaccctttgactacagctgcagaaggggtcctttana

SEQ ID NO: 51898 - DNA, 380 bp, Homo sapiens
  misc_feature 283: n = A,T,C or G
tcttcacttatatgctatatcttgaatgaaagaatgtgtgaattgattctttaaaattatatatttcttttcgataacaataagttttttaaaaaaagcatatttatactaatacttactaaatattttcaagagatatgcatatacaattatgtcagttacttattgataagcccagaaagtaggtatgactgatagaaagtcataaaagttaccaggaagcctttatcttctttgttaaatatagctttctttaaactttgtaagcctttaacaaacttgnggttacaattcttcagaattgtatcatttataacattcaatttttcatgaaacgctgatgcttacatgaccgacagttactgttttttaaaaaggac

SEQ ID NO: 51899 - DNA, 500 bp, Homo sapiens
  misc_feature 5, 215: n = A,T,C or G
ctcanggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggntcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatgggaacaaggcagttgtaaagaaatacatatatc

SEQ ID NO: 51900 - DNA, 310 bp, Homo sapiens
  misc_feature 180: n = A,T,C or G
gctattttttatcattgaaacatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagnggccagaggatcaccagtgcatccttcatcacagcatgtgcaatatgccaagattaccctcggtcattcctgtcaacaaggggtcaatgtcataaatgtcacaataaaacaatctcttcttttttttagt

SEQ ID NO: 51901 - DNA, 250 bp, Homo sapiens
  misc_feature 23: n = A,T,C or G
tctcactcataagtgggagctangttatgatacgaggatgcaaaggcataagaatgacacagtggactttggggattcagggggaaagggtaggaagtggggctgagggataaaagattacaaattgtatgcagtgtatactgctcaggtgttgggtgcaccaaaatctcacagatcaccactcttgtaaccaaacctcacctgttccccaatgccctatggaaataaaaaattaaaagataaaaaaaaa

SEQ ID NO: 51902 - DNA, 320 bp, Homo sapiens
accataaatatcgtgtcatattttccccaagattaaccaaaaataatctgcttatctttttggttgtccctttaactgtctccgtttttttcttttatttaaaaatgcactttttttcccttgtgagttatagtctgcttatttaattaccactttgcaagccttacaagagagcacaaggtggcctacatttttatattttttaagaagatactttgagatgcattatgagaactttcagttcaaagcatcaaattgatgccatatccaaggacatgccaaatgctgattctgtcaggcactgaatgtcaggcattgag

SEQ ID NO: 51903 - DNA, 500 bp, Homo sapiens
  misc_feature 30: n = A,T,C or G
cactcaagtctgttaatggacaaatagaangtcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctga

SEQ ID NO: 51904 - DNA, 500 bp, Homo sapiens
  misc_feature 19, 20, 44, 181, 182, 445, 454, 462: n = A,T,C or G
caaaagaagcctcccagannatcacttacatctgtaaaaacagngtaggatacatggacgatcaagctaagaacctcaaaaaagctgtggttctcaaaggggcaaatgacttagatatcaaagcagagggaaatattagattccggtatatcgttcttcaagacacttgctctaagcggannggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgnatatatggncttaaagngcctggcctccttatccttcagaatatttatttttact

SEQ ID NO: 51905 - DNA, 450 bp, Homo sapiens
ttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgtgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcagga

SEQ ID NO: 51906 - DNA, 210 bp, Homo sapiens
  misc_feature 44, 72, 108, 137, 152: n = A,T,C or G
ggtacacaagaattttttttttcttggggtatgtaagcacattngttcctttatatctgtttacaaaactgngaatcaaaaagacagaactttcttcctagtttttgnaattttttttttgaactagcatgactgtngggttgagctacagncaacaaaaattgggctaagtcacttttccccaggaaagaatatttccctctcctgcat

SEQ ID NO: 51907 - DNA, 430 bp, Homo sapiens
  misc_feature 287: n = A,T,C or G
ggacggaggctgttatctatggccgatctatccaataaaggagagaaaggaccgcatacgcctggttctcatcatatgcaataaagagtttgaccatctgcctccaagaaatggggctgactttgccatcatggagatgaagaagctgcttgaggatctgggttacagtgtggatgtagaagagaatctgacagccaggataacgtgtccaggagagacagcacaaggggctccatcttcatcacacaactcatcgcatgcttccagagatattcctggcgctgccncctagaggaagtattttggaaggttcagcaagcatttgaaagtccggaggcaacagtccaaatgcccaccatagaacgagtgtccatgacaagatatttctacctcttttcctggcaactgaaaatggttaagcattgagagt

SEQ ID NO: 51908 - DNA, 450 bp, Homo sapiens
  misc_feature 26: n = A,T,C or G
ataaatcagacattaaaagtataacntaagggaatgctatgaacaactttatatctaatatttaacaacttaaagttgaaaaatacattgaaagataaaaattaccaaaattaacacacagaacataaaaactgattagctatgtatctgttaaataaattaaatttgttatcacactcttcctatcaaaagcactcatatattagatcacttttgaattctatcaaatttcaaaaaatacgaatttttcacaaactgtttcagaaaatagagaagaaaggaacacatcaccccttttttgatgaacctagctcaatgctaataaataaccaaacaagaacattaaaataaaagaaaattacaagccagtatttctcatgaacttaaatgcaaacattcttaacaaaatatacataaaaatggataatacatcatgactaaatggattat

SEQ ID NO: 51909 - DNA, 450 bp, Homo sapiens
cgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaacacccagagtaaacatcaatgctcagagttagcataatttggagctattc

SEQ ID NO: 51910 - DNA, 130 bp, Homo sapiens
aaacttaggagaaaaactaacagatgaagaagtagatgaaatgatcagagaagcagatattgatggagacggacaagtcaactatgaagaattcgtacagatgatgactgcaaaatgaagacctactttc

SEQ ID NO: 51911 - DNA, 350 bp, Homo sapiens
  misc_feature 324: n = A,T,C or G
aaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagtttagttt

SEQ ID NO: 51912 - DNA, 460 bp, Homo sapiens
  misc_feature 20, 26: n = A,T,C or G
ccatcctgcaactctttttntaatcnggggcacagaggatgtcgctaaagaaaagttgaagagccctttcagcactttctcatctggggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataa

SEQ ID NO: 51913 - DNA, 340 bp, Homo sapiens
cgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaa

SEQ ID NO: 51914 - DNA, 500 bp, Homo sapiens
  misc_feature 24, 45, 486: n = A,T,C or G
ttctcacataagcccagttcatcnccatttcctcctttacctttnagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgngaagagtttcacaa

SEQ ID NO: 51915 - DNA, 490 bp, Homo sapiens
  misc_feature 342, 410, 415: n = A,T,C or G
gtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagntttgtattaaatcagtcatttcatatgcactatatcaagtacaaacaggtagtttacctgtttatagnagggnactaacaaaagtctcccttgcagcttcagactggtatctataggcttatcggtcaaatacagcacttgaatatcc

SEQ ID NO: 51916 - DNA, 210 bp, Homo sapiens
  misc_feature 22, 75, 93: n = A,T,C or G
tgctgagggggcaggcggagcntgaggaaaccgcagataagtttttttctctttgaaagatagagattaatacanctacttaaaaaatatagncaataggttactaagatattgcttagcgttaagtttttaacgtaattttaatagcttaagattttaagagaaaatatgaagacttagaagagtagcatgaggaaaaaaaaaaaaaaa

SEQ ID NO: 51917 - DNA, 400 bp, Homo sapiens
  misc_feature 252, 385: n = A,T,C or G
cattaccttcatggtaaatgcaccaggagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgncaaagcttttctatgtctatatttatcactgaatagtcccagtatggttttaaagcaagttttatgaatctcatttgcctaacaggaatctgaaatataacttgccaaaaacacacagttggtgtggaatggncattagaacctgggg

SEQ ID NO: 51918 - DNA, 350 bp, Homo sapiens
  misc_feature 5, 27: n = A,T,C or G
ggaanccaatataatactacatgtatnaaaacttaaatattttacaagttacatatagcatcattctaaaataagaatttttttgttttctgtctgcttttttcttatgtctcttggtgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaac

SEQ ID NO: 51919 - DNA, 270 bp, Homo sapiens
acaacaaaaaatttaactccatatgtgttcctcttgttctaatcttgtcgaccagtgcaagtgaccgacaaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacacggaaaaaaaaaaaaaaaaaaaa

SEQ ID NO: 51920 - DNA, 200 bp, Homo sapiens
gttagcaaagtattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattg

SEQ ID NO: 51921 - DNA, 228 bp, Homo sapiens
  misc_feature 21: n = A,T,C or G
ggacaacagaacaatattggnatgggggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtgaaaaaaaaaaaaaaaaaaaaaaaaa

SEQ ID NO: 51922 - DNA, 270 bp, Homo sapiens
  misc_feature 22: n = A,T,C or G
cttaaagaaacagctttcaagngcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttgggttaaaaaaaaaaaaaa

SEQ ID NO: 51923 - DNA, 200 bp, Homo sapiens
  misc_feature 105: n = A,T,C or G
aatctgttagaaacagataatacttgtctgaaatccatatgtttcatatgatctaaactgtattttccaatttaaattaaaaatgtaatatagattcagaaaggntcatatttttctaatgacttcattctatattattttgttaggttgcataaagaagcaagggaattgtacttgtattaaaagatgaagaaagctat

SEQ ID NO: 51924 - DNA, 300 bp, Homo sapiens
  misc_feature 26, 28, 93, 166: n = A,T,C or G
aaacatccctcagaataatttagctntntatcattagaaagggaaagctatcatttttattttaaaactaaacaaggccatcttataaactgncaccaaagtcttcccttttttattgcctgtgcgccttgaatttcataaaacattaattcacaatgggggtcangaatgtactcttgttgaaacacttcttgtaccattttatgttcatattatgtttgagagggtaaaaatgtatgagcagcttaactgaagtagaactattcatgatgcttttcacacattgtggcataagatgta

SEQ ID NO: 51925 - DNA, 292 bp, Homo sapiens
  misc_feature 22, 26: n = A,T,C or G
cggggcaagtgagtagccggangggnactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaaaa

SEQ ID NO: 51926 - DNA, 300 bp, Homo sapiens
  misc_feature 211: n = A,T,C or G
cgcgaggtggcaagaagaagccctgaaacagcccaagaagcaggccaaggagatggacgaggaagataaggctttcaagcagaaacaaaaagaggagtagaagaaactcgaggagctaaaagcgaaggccgcggggaaggggcccttggccacaggtggaattaagaaatctggcaaaaagtaagctgttccttgtgcctgaggagatggngaccctttatttcatctgtatttaaacctctctattccctgccataacatcttttgccacgtatagctggaattaagtgttgtcttgga

SEQ ID NO: 51927 - DNA, 377 bp, Homo sapiens
  misc_feature 29: n = A,T,C or G
atacaaatatgatgtctgatgtaagtganccatgtagtacaagagtaaagacacccaccagccagagttacaggtgaggtcccaaaagtggccaggctggaggtcttctaatgtaattttgttttattttgagaacactgccattggaatgtttctacacgatcctattaagaataatgtaatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtataggatcgtcagggaatagcccaaatgttttaaacgcgaaaaaaaaaa

SEQ ID NO: 51928 - DNA, 316 bp, Homo sapiens
  misc_feature 16, 18, 39, 254: n = A,T,C or G
catgatttctaaaggnancatatttcaaatttacgtagnggatttcaaaattaattaaaaatttaagtttaaaagatgactacaatgagaagttatgctggtaaatcctttctgataatattgttaagaagttatattcatctgaaggatgtgtttctacttagtttttcacaatgcgtgcctttataactaaaatgtcatttttttaaatgacatgtttgcttttttgctttttttcttgtccaatttactgnccacgaaaatactacttataagttaataagaaaaacgaaaaagtagcaggcaaaaaaaaaaa

SEQ ID NO: 51929 - DNA, 500 bp, Homo sapiens
  misc_feature 16: n = A,T,C or G
ttatggccgggatacncagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcat

SEQ ID NO: 51930 - DNA, 330 bp, Homo sapiens
  misc_feature 304, 313: n = A,T,C or G
ggctatttagggtgttttgtggtaccatatgaatttagatatgctttttaaaaatgtctatgaagtatgtcactggtattttgatagaggttgcattatatctgcagatcattttgtgtaatacaaatatttaactattaaaaatgccagttcatgaatgagtaatattattccatttatgtgttaccttaatttgtataatgttctttagagtagaatgtaaggtgtttcaactttttggttaaatttacttcaaactatagttaggtagatggaatttttttgaatttcattttgagatagntactaatgnatagaaatgctatgact

SEQ ID NO: 51931 - DNA, 200 bp, Homo sapiens
  misc_feature 149: n = A,T,C or G
tttaatccctttgtgacttccgaccgagcaagaaatcgcaaaaggcttttcaatgcaccttcccacattcgaaggaagattatgtcttcccctctttccaaagagctgagacagaagtacaacgtgcgatccatgcccatccgaaaggntgatgaagttcaggttgtacgtggacactataaaggtcagcaaattggcaa

SEQ ID NO: 51932 - DNA, 337 bp, Homo sapiens
  misc_feature 10, 24: n = A,T,C or G
catggcgacncaacatcgagcagnatttttaggtctttcgtggtcagtaaattccgggaaattcaacaggagccttccagtggaaaggaatgaaggccagctgaatggtgaaacaaaatacacccattgaaggaaaccaggcgggtgatgcagctccctctgccaggagtctaccaaatgaagaaatagtgcagaagatagaggaagtactttctggggtctttagatacagaactacgatataagccagacttgaaagagggctccagaaaaagtagatgcgtatctgtacaaacagatcctactgatgaaattcccactaaaaagtcaaagaagc

SEQ ID NO: 51933 - DNA, 390 bp, Homo sapiens
gcagcatttacaaactggccaagaagggccttactccttcacaggatcggtgtaatcctgagaagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggcgcataaatttgtctgtgtactcaagcaataaaatgattgttt

SEQ ID NO: 51934 - DNA, 318 bp, Homo sapiens
acattcaaatttgtctggttaaaaaataggtggtagatattgaggccaagaatattgcaaaatacatgaagcttcctgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcaggtgaaatttctgtactttgtatataaaatacataaaacaatagattagaaaccaaaaaaaaaaaaa

SEQ ID NO: 51935 - DNA, 310 bp, Homo sapiens
  misc_feature 41: n = A,T,C or G
tcattccctgagcttggtgcaccctccagtgagacacaagnatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaatt

SEQ ID NO: 51936 - DNA, 340 bp, Homo sapiens
attggtggtcctgatcaagaaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgatagc

SEQ ID NO: 51937 - DNA, 296 bp, Homo sapiens
ccagaatctctgggacgcagttaaagcagtgttaagagggaaatttatagcactaagtgtctgcatcagaaagctagaaagatctcaaatgaacatcctaacatcacaactaaaagaactagagaaccaagagcaaacaaacccctaagctagcagacaagaagttaccaaaatcagggcagaactgaaggagttggagacacaaaaaaaattcaaaaaatcaacaaatctagaagctggttttttgaaaaaaaaattaataaaatagcttgctagactaataagaaaaaaaaaaa

SEQ ID NO: 51938 - DNA, 260 bp, Homo sapiens
tctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtaagtcctagttgctgaggtaagaggattgcttgagcccaggagttcaaggctgcagcaagctttgattgcgccactgcactccagccttggcgacagactaagacgctgtctca

SEQ ID NO: 51939 - DNA, 320 bp, Homo sapiens
  misc_feature 6, 73, 99, 122, 217: n = A,T,C or G
cagtancccgagtctggttttgcatccatagaagaggggaggacagggggcaaaaaggatgcaggggaggctncttgattcccactgaagagctatttntcttgtgagaactttaacagtgntataagaaaaagattcctgtaactgtaatgtcttacaattaacagattgcgggagcagcacatatcaatgaagaaaagaacaaagtgttcttatnccatgaagctggggttaagaaccccagtgttttcaagagccagggacagctctgggtctgtgcagagttgagagatggtgatcacatgcctacagcacagctg

SEQ ID NO: 51940 - DNA, 320 bp, Homo sapiens
  misc_feature 41, 90: n = A,T,C or G
atacgattgtccttcatttgtactgaagtagattgcaaagnggttcatgaattcattggtggctacatatttctctcaacacgtgcaaangaccaaaacgagagcttatgatgaagagatgttctacaaacttaccagtggttgcggtgtgaataggaatactgtttaatgaaactccacggccatagcaatatttaactttaaaagctgtttgttatatactgcttaataaagtaagcttgaaatttatcattttatcatgaaaacttctttgccttaccagaccagttaatatgtccactaaacacgcccgactatta

SEQ ID NO: 51941 - DNA, 500 bp, Homo sapiens
  misc_feature 7, 437: n = A,T,C or G
atccagnaaaatgtgtcagcatgcatagtgctaagaaagcaagccaatttggaaacttaggttagtggcaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaaacttttaatgccttccacattaattagattttctcgcagtttttttatggcatttttttaaagatgccctaagtgtttgaagaagagtttgcaaatgcaacaaaatatttaattacccgggtgttaaaactggntttagcacaatttatattttccctctcttgcctttcttatttgcaataaaagggattgagcca

SEQ ID NO: 51942 - DNA, 400 bp, Homo sapiens
  misc_feature 32, 181, 212: n = A,T,C or G
aacagaacgacaagtaaagccttttagcaagnagggcatgctcacctagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcnagtgaatttcactgatgttgatattcattgngtgtagttttatttcggtcccagccccgtttccttttattttggagctaatgccagctgcgtgtctagttttgagtgcagtaaaatagaatcagcaaatcactcttatttttcatccttttccggtattttttggggttgtttcttgtgggagcagtgtacacccaactcttcctgtatattgccttt

SEQ ID NO: 51943 - DNA, 400 bp, Homo sapiens; identical to SEQ ID NO: 20721

SEQ ID NO: 51944 - DNA, 130 bp, Homo sapiens
aggcagcagcaacgcggaggaaaacgggtagtgaacggagagcgtagtgaccatcatgagcctcctcaacaagccccaagaatgagatgaccccagaggagcctgcaagaagccgagaggaggaggaatt

SEQ ID NO: 51945 - DNA, 450 bp, Homo sapiens
  misc_feature 20, 47, 75: n = A,T,C or G
tcccggggtaatctcggctnttatggccggggatttggtttgggatnaataggaaagctatgcagccaaccaagnatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgtatgtgccaaagctttactactgtggaaagacaactgttttaataaaagatttacatttc

SEQ ID NO: 51946 - DNA, 140 bp, Homo sapiens
  misc_feature 19, 49, 52: n = A,T,C or G
tctttacagtaaacagtgngtaccattccgaccgttacaatggtggagntgncaggtgtcccgctggcccagcattggggctggacacaaggtcgggtggcccaaaaaggagtgctgaatttttgctgcacatgctttaa

SEQ ID NO: 51947 - DNA, 266 bp, Homo sapiens
  misc_feature 19, 33, 65, 140, 180, 195: n = A,T,C or G
gactatttttaagaggagnactgtaatattggntatgcaaagttaaaactgggaggataatttgngttagttgaatgataaaaatcttatgaccctgatttcatttgacacttaagcaatgtaaaatctaggttgggggncttagaaagaactaatatcagccaggaaccgggggcttcncctgtaatcctagcnctttgggaagctaaggggggaggatcgcttgaggtcaggagtttgggcaacatagtgacacccaggctggg

SEQ ID NO: 51948 - DNA, 124 bp, Homo sapiens
tggactttggaaaatatttttttcctttgcgttcatctctcaaacttagtttttatctttgaccaaccgaacatgaccaaaaaccaaaagtgcattcaaccttaccaaaaaaaaaaaaaaaaaa

SEQ ID NO: 51949 - DNA, 415 bp, Homo sapiens
  misc_feature 10, 48, 56, 245, 251, 265, 288, 336: n = A,T,C or G
gaagctctgnttggtgctttggatccatttccatcggtccttacagcngctcgtcngaactccagcagccaagatggtagaagcagatcgagagcaagactgcttttcaggaagccttggacgctgcaggtgataaacttgtagtatgttgacttctcagccacgaggggtgggccttgcaaaatgatcaagcctttctttcattccctctctgaaaagtattccaacgtgatattccttgaagnagatgnggatgactgtcaangatgttgcttcagagtgtgaagncaaatgcatgccaacattccagttttttaagaagggacaaaaggtggntgaattttctggagccaataaggaaaagcttgaagccaccattaatgaattagtctaatcatgtcttctgaaaatataa

SEQ ID NO: 51950 - DNA, 250 bp, Homo sapiens
  misc_feature 18: n = A,T,C or G
acaagtccctattcttancccttgtgactctcagagctttatacttttatgttcgtagccactatggctgataccttagatctctgattattttaaatgggtgggtcagttctaaaagggcggccggagagagctggcccgagtacatgacatttaaatcattgagggatcctaccatggggtcccagatctgaggctcggaagtgcttcttaatgctatcatttgagaatttgggccacctctcctggg

SEQ ID NO: 51951 - DNA, 300 bp, Homo sapiens
tttttcttatctgttgtataaaaatctgaattaatccatatggactcctgaaggaatttcagctcaatttcaagtctcatggattgagactatttttacttactttgtcatagaccagtctgtgttgtaaattctaatttatataatatttactttttgcaatttcatgaagtgttgcaaaataagtatcagaacaagaacgtactttgtttgatgcttatattgcataatacaacgagccttacctccataagtgtttgttggataaataaaataatgaaacaggagtaagtcacaaaa

SEQ ID NO: 51952 - DNA, 400 bp, Homo sapiens
  misc_feature 21, 364: n = A,T,C or G
cattgtgtgagcctatcaganttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttatnggaactctgcttgatttttgcctcttccagtcttcc

SEQ ID NO: 51953 - DNA, 270 bp, Homo sapiens
  misc_feature 247: n = A,T,C or G
ataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatgggggnttcccaccagggaagcctttttg

SEQ ID NO: 51954 - DNA, 162 bp, Homo sapiens
catgttggtgggcgcctgtgatcgtggctactcaggaaggctgaggcgggagaatggcttgaacccgggaggcagagattgcagtgagctgaaatcacaccactgcactccagcctgggcgacagagtgagattctgtctcaaaagaaaaaaaaaaaaaaaa

SEQ ID NO: 51955 - DNA, 400 bp, Homo sapiens
  misc_feature 292, 314: n = A,T,C or G
caagatctgttaatggacaaatagaaagcctcattagtcctgatggttctcgtaaaaaccccgctagaaactgcagagacctgaaattctgccatcctgaactcaagagtggagaatacttgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccctggatgggnggttttcagtttagctacggcnatcctgaacttcctgaagatgtccttgatgtgcagcttggcattccttcgacttctctccagccgagcttcccagaacatcacata

SEQ ID NO: 51956 - DNA, 200 bp, Homo sapiens
  misc_feature 25, 144: n = A,T,C or G
tagatttagtgtaataagacttagnattgtgctccttcggatatgattgtttctcaaatcttggcaatattccttagtcaaatcaggctactagaattctgtattggatatataagagcatgaaatttttaaaaatacacttgngattataaaattaatcacaaatttcacttatacctgctatcagcggctagaaaaca

SEQ ID NO: 51957 - DNA, 350 bp, Homo sapiens
gagttagtgcaggtcctgaaacgcgggctgcagcaagaatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtg

SEQ ID NO: 51958 - DNA, 340 bp, Homo sapiens
aacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctactccaaattcctccctgtacgaaaggacaagagaaataaggcctacttcacaaagcgccttcccccgtaaatgatatcatctcaacttagtattatacccacacccacccaagaacagggtttgcaaaaaaaaaaaaaaaaaaaaaa

SEQ ID NO: 51959 - DNA, 420 bp, Homo sapiens
  misc_feature 1, 384: n = A,T,C or G
ngtacttctccatgcttctagtcggaaaagaacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaaactacatgtggccagctccattcttccacactgcgtactacatttcctgccttttctttcagngtttttctaagactaaataaatagcaaactttcacc

SEQ ID NO: 51960 - DNA, 490 bp, Homo sapiens
  misc_feature 28: n = A,T,C or G
cccttcagttgtttcgggacgcgccgancttcgccgctcttccagcggctccgctgccagagctagcctgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgcataaaagcatatgtgctactcatctttgctcactatgca

SEQ ID NO: 51961 - DNA, 310 bp, Homo sapiens
  misc_feature 298: n = A,T,C or G
taattttgatctcttgattaaggagagtctgcaaaatttctactttgtaaatgtacctttttctttttgtaactaacaagtaatctgtagaggcagttattttaggttagagtattttgttcccgatctttcacacaatgttattagcataaatcaatgaatcctgtctgaaataattacttttatgatgtttcaagatgatgacttttcagtttctagcattctttctatatttatttggtggcactcatttgtataaaagaacgtcatcttctgatgttcctaatttttaaaatgnttttaaatggaa

SEQ ID NO: 51962 - DNA, 440 bp, Homo sapiens
attgtaggattattcacaatagttaagatttagaaacaacttaagtgtctattgacagatgaatagatgagaaaatatggtatataaatagtggactattattcagccttaaaaaagcaggaactattgccgtatgtgacaacaacatggatgaaacttaaagacattgtgctaagtgaaatacatgagtcatagaaagacacatattgcatgattccacttatatgagttatctaaaatagtcaaattcatagaatcaaagagttggattgtggttaccagtgggtggaggtagagagaaggtagagagaaatggggagttactaaacaatgggcgtaaagtttcagtcaagaaagatgaataagttctagggatctgttatacaacattgtacctatagtcaacaataatgtattgtacacatatgcatttgttaaga

SEQ ID NO: 51963 - DNA, 264 bp, Homo sapiens
gcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcccc

SEQ ID NO: 51964 - DNA, 465 bp, Homo sapiens
acagaattgaggttgagaccaaaaaaatgtgtgctctaaatcatgtttttgcagaaactaagtggaagtttccagtgtggatgtcattttggttgggaacacacatttccttaggaaaagcaggaggctgtgatggaagaaactaaggatcttgaaattggatagacctattaccaccttccctaacttcaagacttcaaggagaaggaagaaggagatttgagacccagagaaacagaggaagaggccatgagaacatggaggcagagactggagggcaatcatgaactaaaaaccaccaaggattgcagaagtcaccagaggctgggaaagaggcacagcatggattcttccacagagcctccacatggaaccagtactgccaaaaccttgatttcaaatatctggccttaaaaactgtgaataaataatttcctattaagccaaaataaaaaaaaaaaaaaa

SEQ ID NO: 51965 - DNA, 300 bp, Homo sapiens
atttgaaactatcccgtttgcttttagtgagttaactactctttattcccccttattaatgaaattcatattcttaaattgacaagcttattaggcaacgttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaattccagtggctttaccccacttgaaaaattagtggggataagcc

SEQ ID NO: 51966 - DNA, 470 bp, Homo sapiens
gtaactaagggacatcaaaattaaatgatttatccagtgtcattcagtttgtcagcactgctgaattataggtagccatgtcccctgcacactctctgtgttaaggattttactgtctagggattctgaatgttcaggatcttctttgctattattaaaggagagattaagctcaattaaaaattaccaaaaaaatcagctgtattgtcattagagggttaatcgaaattttaatgttatagatcatattaaccttttctaaataagagcaccttcatctgagtttatccttgtcagacttgccccttataacattaggcagaccatgactcctcttcaatcctaataggtggaagaagacatcaggacagcatggaagtgtgtccacaattactctgggttgtcacaaagatcttgactgttatctaggatgaccctttttagcatttgagcggtctctttaaaaaaaa

SEQ ID NO: 51967 - DNA, 500 bp, Homo sapiens
  misc_feature 478: n = A,T,C or G
tatggccgggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagaaaagattcccgagagtaaatcatctttccaatccagaggaacaagcatgtctctctgccaagatccatctaaactggagtgatgttagcagacccagcttagagttcttctttctttcttaagccctttgctctgggaggaagttctccagcttcagctcaactcacagcttctccaagcatcaccctgggagtttcctgagggttttctcataaatgagggctgcacattgcctgttctgcttcgaagtattcaataccgctcagtattttaaatgaaagtgattctaagaattttgggttnggggatcaataagggaaagcat

SEQ ID NO: 51968 - DNA, 350 bp, Homo sapiens
  misc_feature 24, 305: n = A,T,C or G
aagcttaaaaacataccaactgtngtgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggggtatgtttttctgtgtgtcaagttttcatagtatccatattttattactgnttattacttccatgaattttaaaatctgagggaaatgttttgtaa

SEQ ID NO: 51969 - DNA, 400 bp, Homo sapiens
  misc_feature 76, 118, 394: n = A,T,C or G
gctttctttgcaagtattgtaaattatatttgtgctatagtatttgattcaaaatatttaaaaatgtcttgctgtngacatatttaatgttttaaatgtacagacatatttaactggngcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatggaccactgaaatctgtcaagagtagntatata

SEQ ID NO: 51970 - DNA, 260 bp, Homo sapiens
  misc_feature 33, 45, 57, 121, 192, 216: n = A,T,C or G
tttgtgtaggtgaatctcggttttatttgtggngatatctaatgntttgtaggcacntgggccagaattattacatgctaagctggggtagtataaagaaagataattctaaagctaaccnaagaaaatggcttcagtaagttagggatgaaaaatgaaaatattaaataaaggagaaaatctcgggggggnttaaaaaaaatgcctcaatttggnaatctacctcctctccccaccccccaaaaaaaaaaaaaaaaaaa

SEQ ID NO: 51971 - DNA, 391 bp, Homo sapiens
  misc_feature 22: n = A,T,C or G
ctgtaataatgataatgaagtnttttcataatggtgtaaccagttggcaattcttcaaaaagaaacaaaataatcacacggtggtaatttcctctcttgggtatactacagacccgtgtatcccagcagcctgagtgaccaggcagggtgggttctggttctccttgtactgtggcctttcctatgcatgcagataggagttgaatctacacatgagcagagtaagtaacaatatgcagtaataaaagtgacatgaactgaagtcaggtaaggcggctcatgcattcagccagcacttacaaggcagaggcaggtacatctctgtgatctttaaggccacctcagtctacagagtgagaccttctctcaaaaaaaaaaaaaaaaaaaaaaa

SEQ ID NO: 51972 - DNA, 394 bp, Homo sapiens
  misc_feature 52: n = A,T,C or G
cgcttacaaagttctgtttggttagtattggcatagtttttctatatagccntaaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgaaccctttccccagctgtccactgaaacgtgaagtcctgttttgaatgccaaacccaccattcactggtgctgactacatagaatg

SEQ ID NO: 51973 - DNA, 472 bp, Homo sapiens
  misc_feature 3, 5, 19, 20, 32, 36, 114, 131, 154, 159, 162, 164, 171,176, 177, 181, 183, 192, 196, 200, 206, 209, 212, 216, 225,226, 232, 236, 251, 252, 253, 261, 262, 263, 264, 265, 267,271, 273, 274, 275, 276, 277, 284, 286, 294, 300, 306: n = A,T,C or G
  misc_feature 314, 315, 317, 321, 322, 325, 328, 330, 333, 335, 337, 338,340, 345, 354, 362, 363, 364, 365, 368, 369, 372, 379, 382,386, 394, 395, 396, 397, 403, 407, 408, 409, 410, 411, 412,413, 414, 415, 419, 422, 424, 426, 429, 430, 431, 432: n = A,T,C or G
  misc_feature 435, 436, 437, 439, 440, 442, 444, 454, 456, 461, 464, 467,469, 470, 472: n = A,T,C or G
acncncccgggaattcggnnttatggccggcnaggngaatccgactgtttaattaaaacaaagacatcgcgaaggcccgcggcgggtgttgacgcgatgtgatttctgcccagngctctgaatgtcataanaaagaaaataataaaacaaactnttgtnggncncccctgngcccnnaccnantttttaacnccgnaaantttttntcnggngcgnccgattttnnggcctntttngccaatttccccttnnngggggggnnnnnanaaanannnnnccgccangncggcgggngaaagnccgtcnctaatccnngngctnntcnttngnatntngnngnccgcncctcccccngagagcannnnctnnatngcgccgnggncggntttgccannnnttgggnccannnnnnnnncccnaancngnggnnnnggnnncnntnancgggggcttncncccgngcnccngnntn

SEQ ID NO: 51974 - DNA, 500 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataattttgaaggcgatcttttaaaaagagattaaaccgaaggtgattaaaagaccttgaaatccatgacg

SEQ ID NO: 51975 - DNA, 155 bp, Homo sapiens
aggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaa

SEQ ID NO: 51976 - DNA, 500 bp, Homo sapiens
  misc_feature 227: n = A,T,C or G
ttatggccggcgaagcactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttancagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatatttgaaagcatcccctgttgggataaatttctgagtaaatgcattggatcagttggactttgaacgcctttgaaatggctttgc

SEQ ID NO: 51977 - DNA, 400 bp, Homo sapiens
  misc_feature 55, 62: n = A,T,C or G
atgtgcttcgaagtattcaataccgctcagtattttaaatgaagtgattctaagnatttggnttgggatcaataggaaagcatatgcggccaaccaagatgcaaatgttttgaaatgatatgaccaaaattttaagtaggaaagtcacccaaacacttctgctttcacttaagtgtctggcccgcaatactgtaggaacaagcatgatcttgttacctgtgatattttaaatatccacagtactcactttttccaaatgatcctagtaattgcctagaaatatctttctcttacctgttatttatcaatttttcccagtatttttataccggaaaaaattgtattgaaaacacttagtatgcagttgataagaggaatttggataattatggtggggtga

SEQ ID NO: 51978 - DNA, 220 bp, Homo sapiens
  misc_feature 52, 114: n = A,T,C or G
acaaatagaaagcctcattagtcctgatggttctcgtaaaaaccccgctagnaaactgcagagacctgaaattctgccttcctgaactcaagagtggagaatactggggttganccctaacccaaggatgcaaattgggatgctattcaagggattcctggaatatgggaaactgggggaaactgcctaagggccattcctttgaaaggtccccgggaac

SEQ ID NO: 51979 - DNA, 410 bp, Homo sapiens
  misc_feature 219, 329: n = A,T,C or G
gaacgaatttccaatgtgaaagacgtcaataacttctttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaagcactgaaaaccaattactgaaaaaaaattgacagctagngttttttaccgtccgtcattacccaaagacttgggaactaaaatgttccccagggggatatgctgattttcattgggcacatggactgaatcacatagattctcctccgncagtaacccgggcgattatacaaattatgtcttccaaagtatggaacactccaatcagaaaaaggttatcattggggccgt

SEQ ID NO: 51980 - DNA, 500 bp, Homo sapiens
  misc_feature 473, 490: n = A,T,C or G
gctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcactttccccatcaacgttgttatccaggagaatgggtctctttgttgaaatccgaaatttcttgggtgaaaaatacatccgcagggttcggatgagaccaggtgttgcttgttcagtatctcaagcccagaaagatgaattaatccttgaaggnaatgacattgagcttgnttcaaattca

SEQ ID NO: 51981 - DNA, 480 bp, Homo sapiens
aggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcaagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacattgctttgattccccgatggagtagactgccttttgttccatacaggcaaagtaaggatatttttaatatcatcctacttcttattagcaatttcatttggctatggacctggattt

SEQ ID NO: 51982 - DNA, 500 bp, Homo sapiens
  misc_feature 448: n = A,T,C or G
ataaaacccttgtttttttccctgactgaggtcaggcactgctgtttaaaatgtagtcttaatgaacaaaatgaaacgttgaaagaggacgagtcaaaatgcccaaaagatgtaaacatcaaagagaaaagatccagaaattattaaaagttaaacttcccttgaattctagtattaagaaagtactgcttcagtaaaatggcatatatttttctgaaactgtttttctatagtattttgtgtggaggatgacagatttctaaaggtgaaaaaagaataggtattttttctgtttaatattcaattttataggagagtagtacgttaattttttttaaaccccagaagctcaggatcttatcattttaaaagaaattatcaccagttctgtgtgagtaaataaagtattataacacttttgggggtttttcattccatgataccttgnatttaccttacctgagcttttttttctaggggaaagaaaaatgctcagggaa

SEQ ID NO: 51983 - DNA, 380 bp, Homo sapiens
cgcaggcagaagctctgcccttctgtatcctactgtatgcagtgtgctttttctttgccagcttgggccattcttgcttagacagtcagcatttgtctcctcctttaactgagtcatcatcttagtccaactaatgcagtcgatacaatgcgcagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctatttaaagtacttcttacacattggaaaaaaaaaaaaaaaaa

SEQ ID NO: 51984 - DNA, 420 bp, Homo sapiens
  misc_feature 53: n = A,T,C or G
tagaatataaaggaggcatcagcaaaacacactctctaaagccacttccttgngcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaataagtgtgggacgtccttttgcagtctggtgtgcatgccattatgatcaggacagcttttccactttactcggtttcctacaagcaagtaggaaatacagtgaatttaccctaaaatgtccaatctgtattttatgtaccttgtcagtgtcctt

SEQ ID NO: 51985 - DNA, 339 bp, Homo sapiens
  misc_feature 20, 72, 75, 112, 118, 143, 146: n = A,T,C or G
caactaaacaaacacaaagnattctgtgtcaggtattgggctgggctggacagggcagttgtgtgttggggnggnttttttctctattttttttggtgggttcttggttttnaataanggttacaatctgcctcaatcactcnggngtttataaagattccacctccagtcctctctcctcccccctactcaggcccttgaggctattaggagatgcttgaagaactcaacaaaatcccaatccaaggcaaactttgcacatatttatatttatattcagaaaagaaacatttcaggaatttataataaagagcactattttttaacaaaaaaaaaaaa

SEQ ID NO: 51986 - DNA, 439 bp, Homo sapiens
tcctgcagaaggacacacgactctatttcctacagtgcgaaacttgtccttctagatgttctgttgccagtatcaaaaccggcttccaggctgtcacgggcaagcgagcacagctccgtgccaaagctaactaatttgctaatcactgattttgcaaagcttgttgtgggagatgtggctggacaggtttgccatcagagtggatatacccgttgtattaaaaacaagataaaaaaagctgccaagatttttggcgagtggttggtctgaagtccttgcaagacgctgatgctcaagctgttgacatactcattgcctactttaacacctgtcagagaaacgtgatatggggtaaagggaggtgctttttttaaaatcgttcatagacttctgtaaaatgcaagataaattaaaagttattataacagtgggaaaaaaa

SEQ ID NO: 51987 - DNA, 380 bp, Homo sapiens
  misc_feature 220, 241, 276, 314, 358: n = A,T,C or G
gtcacccggatcggtgactgtggagggcgagctgagccctggccgccgccacaatgggccgcgagtttgggaaatctgacgcggatgcggcatgtgatcagctacagcttgtcaccgttcgagcagcgcgcctatccgcacgtcttcactaaaggaatccccaatgttctgcgccgaattcggggagtcttttctttcgcgtggtgccgcagtttgaggngttttatcttatctacacatngggggactgaagagttcgagagatccaagaggaanaatccagctgcctatgaaaatgacaaatgagcaccgcntccggatgacgggtcccctgtctctgaaagaccttttctctggnaagaggagtctgcatttgtagt

SEQ ID NO: 51988 - DNA, 424 bp, Homo sapiens
gctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaaattttccttcaaaaaaaaaaaaaaaa

SEQ ID NO: 51989 - DNA, 256 bp, Homo sapiens
tcccaatggtgcagcccgcttatttaaaaggttcgtttgttcaacgaattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgaaaaaaaaaaaaaaaaaaaaaaaaaaa

SEQ ID NO: 51990 - DNA, 480 bp, Homo sapiens
  misc_feature 13, 303: n = A,T,C or G
agtccagtaagangccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgactttcactaacgnggggaaaacaacctgttcttctggctgacataaatgacttcaatactgtcaatgaaatctacaaacagtatttcaagagtaattttcctgctagagctgcttaccaagttgctgcttttacccaaagggcagccgaattgaaattgaagcagtagcttttccaaggaccactgacaa

SEQ ID NO: 51991 - DNA, 560 bp, Homo sapiens
  misc_feature 477: n = A,T,C or G
ttgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgacccctctattgattagccccaagtagaaagtcctgtggttttatgtttaatggaaataggntgatcatatatggcataattttctatcagcttcctactcagtcactataaacacagacttgaaataggactttaaatgtccaa

SEQ ID NO: 51992 - DNA, 500 bp, Homo sapiens
  misc_feature 431: n = A,T,C or G
ggaggtcaaggctgcagtgggccatgatcatgtactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaagggaattggaccctaattatagaaggtgatatgaacagctgttttatcatcctacatgctaccaagctgtaggtgtcccatttaagtcctgctatttaagaaatacttacataacccttaggnactcttcaggctttaaaaggcaaggagcaaataattttaggagaccgataatgtcacctaaatttgaat

SEQ ID NO: 51993 - DNA, 410 bp, Homo sapiens
  misc_feature 4, 5, 7, 8, 9, 16, 21, 26, 27, 35, 41, 43, 48, 58, 60, 61: n = A,T,C or G
tttnncnnnccggggnacacncggcnnctccggcncgggantngaccntccgaccgcncnncacctttgaggaactttgttgattggccctactgttttacttgccaagtgtgaaccgtgtaaagcttggttaaccctgtacactagaatagcttacttgttgactagttactagtgtatttagggttgccttgtaatatttaagcttctttactgatgtgtgtgctggtaggaacatataatttttgtacattatatttactgagacgttgcctttttttattttacaaatactttggaattccaatgtgttttttgcttccgtgaggattaatttggaaaggtttttaatgacattccactgatttcagattttgcttgagattgacttcaataaattgtcctgtatg

SEQ ID NO: 51994 - DNA, 430 bp, Homo sapiens
  misc_feature 389: n = A,T,C or G
aggagttggattcctggatcacatggtacctctatttttagttttttgaggaacctctaaattgttttccataatggttttactaatttacattcccaccaacagtgtatgagggttctcttttctccacatcttcactagcatttgttattgcctgtataagacataaatcttaagcagtattacaaataaagagtctatatattgtgtgaacttgcatatcttatgcataccaatatgctatgaaacatcttaatgtatttgataaaatcttgtcctgacacagttttggggggttccatatgaaacatcatgcagatcataccccaaaacattttattttacccaaaacccagttatgtcattaatagaaaagaggggaaattttnttcagaagtaatggatcaacctcttagctttgtttgatgat

SEQ ID NO: 51995 - DNA, 500 bp, Homo sapiens
  misc_feature 472: n = A,T,C or G
agaaaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgctttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgntgctatgatgtaactgcatttgacctaa

SEQ ID NO: 51996 - DNA, 500 bp, Homo sapiens
  misc_feature 20: n = A,T,C or G
cagcttactcataacaaganccaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatggagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctgggaggtcaatcaacttggagaagtttgacataaagagcttctgcaagatcctggggccattatcctactccaagatcaagcat

SEQ ID NO: 51997 - DNA, 443 bp, Homo sapiens
  misc_feature 298: n = A,T,C or G
acagacaaaagctacagtataaaaatttccttgaaaactcctacaatattactactttggaggcagcttcagactgttttattgggggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgnccattttcctgtttgttaaaataacatacctctcctacgtattattttcttgacccaaatgaaatattaacctaaggtcaagctgggagagagaaatgactgagatgaatgtctttactaaagtaccaataaatttgtcaaacgc

SEQ ID NO: 51998 - DNA, 530 bp, Homo sapiens
  misc_feature 14, 27, 29: n = A,T,C or G
ggccgggtaagccnaaacaactggttnantgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactattgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataaggggagggagttttaatggttaccatgggagtcctgcaacactaaagatattttgaatatcagtcatgatggca

SEQ ID NO: 51999 - DNA, 480 bp, Homo sapiens
gagagaaattgatctctgtctgagctctgaagggtccgaagtgattttagctacatcaagtgatgaaaaacacccacctgaaaatctcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaacca

SEQ ID NO: 52000 - DNA, 500 bp, Homo sapiens
  misc_feature 490: n = A,T,C or G
atagcagggcatgaaaaacttagagtggtacaagtggctgaaaatcgagtttttcctctgtctttaaattttactatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcanaagctcttct

SEQ ID NO: 52001 - DNA, 310 bp, Homo sapiens
  misc_feature 100, 121, 269: n = A,T,C or G
aagtaaggcacttagagtcatgaccaatatatattaataggaggctcacaaaaaaatctagctcttactgcaactcctactactcctatttttttttttnaaaacaacttttatttttgcncccctgtactggaataaatgatcttgggcctggtttctgtaaccaacactgactgtcataatctgtaaggataagcacttagggcctaaactgaaatctccaagtctggcttttaaaaaagaaagacccttggctggctaggcacagnggctcacccctgtaatcccagcattttgggaggctcaggca

SEQ ID NO: 52002 - DNA, 246 bp, Homo sapiens
  misc_feature 12: n = A,T,C or G
tgaaaacccccntcgccaaaactcaacaactacttctctcaaaatactaaacagaggtggtttactagacaaagacttttggctgtttggttttccactacttctctattggctaaaatttgtttaatgagcatgaaatgtttttattttattttgcttatttttatgattgcaaaaaatgatatgagtttctccctgccaaggcaaaaaaatatatatatacctgtaaaaaaaaaaaaaaaaaaa

SEQ ID NO: 52003 - DNA, 100 bp, Homo sapiens
  misc_feature 88: n = A,T,C or G
atttgcttaagttgtcactatcttatataagctcaagaaaatagccggaatgattaaacaaataatggcatggaatctcatcttgggncaaggcagcggt

SEQ ID NO: 52004 - DNA, 210 bp, Homo sapiens
  misc_feature 156: n = A,T,C or G
agctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaatnggagatttttatgcagaaactaaataatccttaataaataaatctctattttgg

SEQ ID NO: 52005 - DNA, 308 bp, Homo sapiens
  misc_feature 15, 107: n = A,T,C or G
ccattgcctgcaaangactattttgtagtacacaatgaagctgaagggaaagaagtaggcagaaatgagcagttcgctcctccctgataagagttgtcccaaagggncgcttaaggaatctgccccacagcttcccccatagaaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaaa

SEQ ID NO: 52006 - DNA, 520 bp, Homo sapiens
  misc_feature 506: n = A,T,C or G
gacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcaccaagggngacacatctggaga

SEQ ID NO: 52007 - DNA, 500 bp, Homo sapiens
  misc_feature 26, 449, 475: n = A,T,C or G
aaaaactgacacagtcaattcagaanaatggactgaagtctgaataaggtccttgcattttaaaaagcatactaactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttgggtttttacttctgcacttaaatttttttaaataacatgatgatggnacattttcctctattgtctagctaanggctttccggtccaccagtaaataa

SEQ ID NO: 52008 - DNA, 170 bp, Homo sapiens
tcttcaaactctgaactttttggttgagtccttcgtttactccctttatattctcagttctaatcaccctaccttaagagccctaacccctattctaaaagtaaaatgccccttttccttactttgtctacttactttctacaaaaaaaaaaaaaaaaaaaaaaaaaaaa

SEQ ID NO: 52009 - DNA, 450 bp, Homo sapiens
tctttggacccctaatcctggtggacctgatggacttgcccaggtcgcgcatcaacgccggcattgctagctcaattcctcgacaagcctgtctgcttcgtagggaggctggaaaagattcatcccaccggaaaaatgtttattctttcagatgggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacattgattgatccttgatgggattttcatacgattgtaaatgagctatatttaaagtctattaaaggaagccct

SEQ ID NO: 52010 - DNA, 430 bp, Homo sapiens
  misc_feature 365: n = A,T,C or G
ttcaaccaatactgctgaatgaataaatattttttgctttagtttttcttataaggctaaaaattcacaaggcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaactctgatggtgatgtacaaggaatttaatgttctcatgtctgntgatgcaacatctgttctgccgcccagggaccaagaagccacctcaactgaagtcttattattta

SEQ ID NO: 52011 - DNA, 319 bp, Homo sapiens
  misc_feature 10, 42: n = A,T,C or G
taaataaagnaggtaagaaacctaggaccaaagcacccaagnattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactccgaaaaaaaaaaaaaaa

SEQ ID NO: 52012 - DNA, 379 bp, Homo sapiens
  misc_feature 304: n = A,T,C or G
atgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgccttgccgngtgaaccatgtgactttgtcacagccccaagatagttaagtggggatcgagacatgtaagcagcatcatggaggt

SEQ ID NO: 52013 - DNA, 316 bp, Homo sapiens
  misc_feature 221: n = A,T,C or G
aaactgattgaataaataaatctccttttcttcatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagttnaaaatgtttaacttgtgatcgagacctacatgcatgtcttgatattgtgtaactataatagagactctttaaggagaatcttaaaaaaaaaaaaa

SEQ ID NO: 52014 - DNA, 430 bp, Homo sapiens
  misc_feature 8: n = A,T,C or G
tatccagnaatataaaagaacacctataactcaataataaaaaagacaacccaatttaaaaataaggaaaggatttggatagatatttctccagataacatacacagatagccaataagcacttaagatgctcaatatcattcatcattagggaaatgcaaatcaaagccacagtgaaatacaacttcacgcccatggatacagctataagcaaaagacagataataacaaatgttgctgagaatgtggaaaaactggaattctcgatcattgctggtgagattggaaaatgctgcaaccactttagaaaacagtttggatgttactcaaaatgttaaagagttaccatgtgacccagtaagtccactcatagatatatacccaaaagaatagaaacatatgttcacacaaaaaaaaaaaaaaaaaaaaa

SEQ ID NO: 52015 - DNA, 270 bp, Homo sapiens
  misc_feature 3, 266: n = A,T,C or G
gancttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgnccca

SEQ ID NO: 52016 - DNA, 180 bp, Homo sapiens
ataaaaacaaatgcccttctgaattgcattctaaagcatggcttggggagtttggagcttagtggagtagccttgtattgcttacagtgtagccttgtattccccggagcccttggctagacaccccattaaatcccaacactctgatgatttctcttaaaaaaaaaaaaaaaaaaaaaa

SEQ ID NO: 52017 - DNA, 380 bp, Homo sapiens
  misc_feature 110, 141, 149, 183, 192, 237, 288, 326: n = A,T,C or G
atgtcagatgggggtaaaatccattaaagaacaggaaaaaataattataagatgataagcaaatgtttcagcccaatgtcaacccagttaaaaaaaaaaattaatgctgngtaaaatggttgaattagtttgcaaactatntaaagacntatgccgtaaaaagtctgttaatgcccatcctgngggaatggngtgttctaaccaattgccttttcttgttatctgagctctcctatnttatcatactcagataaccaaattaaaagaattagaatatgatttttaatncccttaacattaaactcttctaactttcttctttctgngataattcagaagatagttatggatcttcaatgcctctgagtcattgttataaa

SEQ ID NO: 52018 - DNA, 161 bp, Homo sapiens
gttttctggcaaaggccttcctgcatttatgaattctctctcaagcaagcaaggagaacacctgcaggaagtgaatcaagatgcagaacacagaggaataatcacctgctttaaaaaaaataaagtactgttgaaaataaaaaaaaaaaaaaaaaaaaaaa

SEQ ID NO: 52019 - DNA, 380 bp, Homo sapiens
  misc_feature 157: n = A,T,C or G
aattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggntccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtg

SEQ ID NO: 52020 - DNA, 384 bp, Homo sapiens
gaacgtttcccgtgtctctagaagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatacaaaaaaaaaaaaaaaa

SEQ ID NO: 52021 - DNA, 510 bp, Homo sapiens
cactataattctaaaacattttttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattggttcatgtttgtatgggaaaattgtagctaaacatttcattgtccccagtctgcaaaagaagcacaattctattgctttgtcttgcttatagtcattaaatcattacttttacatatattgctggtacttctgctttctttaaaaatatagtaaagggatgtttttattgaa

SEQ ID NO: 52022 - DNA, 258 bp, Homo sapiens
aggaaagtatgtatttgtacaccggaactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaaaaaaaaaaaaaaaa

SEQ ID NO: 52023 - DNA, 348 bp, Homo sapiens
tgttctggaactacagccttgtccttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagt

SEQ ID NO: 52024 - DNA, 248 bp, Homo sapiens
  misc_feature 39, 41, 57, 84, 155: n = A,T,C or G
aatcaaattgaatatatcttttaagaattcaaaactagngnattcacttaccctagntcattataaaaaatatctaggcattgnggatataaaactgtggggtattctacaacttcaatggaaattattacaaggagaggaatccctctttttgngacacaagtacaatctaaaagttatattggaaaacatggaaatattaaaattttacacttttactagctaaaacataatcacaaagctttatc

SEQ ID NO: 52025 - DNA, 430 bp, Homo sapiens
  misc_feature 9, 371: n = A,T,C or G
agaacaagnacagacagcaaattcaaatacctttcaagaagtttggtggtgaaggaaagcagagaatccaagtgatagcttaaggatcaaggctggtttgaaaaaaaagataattggtgctttatttttcctctaggttaggacaggcttgagcacacttgtagctagagaggagagttgccagaaggacctgaagactgaaagaatggagattatttccggtcccataaaagtcaagagtgtatatgggatctacagcacagctagaaaggtttgacccaacagggagtagagacatttctttctctgtgacagaagggtaaggaaggagtaaagagaaagacgtttgaagaatattatcaaatactgcngagattaatcgtacatttgcagtagacctgggatcccatgtagttctttagttacataa

SEQ ID NO: 52026 - DNA, 251 bp, Homo sapiens
  misc_feature 140, 151: n = A,T,C or G
aggcattgaggcagccagcgcaggggcttctgctgagggggcaggcggagcttgaggaaaccgcagaataagtttttttctctttgaaagatagagattaatacaactacttaaaaaaatatagtcaataggttactaanatattgcttancgttaagtttttaacgtaattttagtagcttaagattttaagagaaaatatgaagacttagaagagtagcatgaggaaaaaaaaaaaaaaaaaaaaaaaa

SEQ ID NO: 52027 - DNA, 480 bp, Homo sapiens
ccatccaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaa

SEQ ID NO: 52028 - DNA, 317 bp, Homo sapiens
attgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcaggaagtctctaatatatcatttgtcttttttccagtgaggtaaaataaggcataaatgcaggtaattattcccagctgacctaaagtcaataaaacattctgtgaaaaaaaaaaaaaaaaaaaaaaaaaa

SEQ ID NO: 52029 - DNA, 160 bp, Homo sapiens
  misc_feature 24, 25, 26, 113: n = A,T,C or G
taatatatttaatgaaaagaagtnnnacataaatgtgtgaatttccagttttttttttaattattttaatcccaaacatcttcctgaaaataacattcccttaaacatgctgnggaataaaatggattgtgatgaaaaaaaaaaaaaaaaaaaaaaaaaa

SEQ ID NO: 52030 - DNA, 310 bp, Homo sapiens
  misc_feature 97: n = A,T,C or G
ctcacccattgcatgcaatggactattttgtagtacacatgaagcagaagggaaagaagtaggcagaaatgagcagttcgctccctccctgataagnagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtatttgtttgcatccccttgccctcaataaataaagttcttttttagttcc

SEQ ID NO: 52031 - DNA, 402 bp, Homo sapiens
  misc_feature 322: n = A,T,C or G
ctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctattggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagtnaagaagagaaagggccaagtgatccagttctaagtgtcatcttttattatgaagacaataaaatcttgagtttatgttcc

SEQ ID NO: 52032 - DNA, 340 bp, Homo sapiens
catttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactatg

SEQ ID NO: 52033 - DNA, 372 bp, Homo sapiens
atattattattttattaacacattaaaaaaaacccataagaggattatagagtttttccctatcctacttctcagagtgttttaagcacactgtagaatttattcactcatgaatttgatacaaactaaagtgaaaatctcttctcaggaacctcataatgcttagaaagcatagtaacacgttcagagaaagaggaagatcaaatttagaggaagctcttgtttgagtttctgccacaatgagtttcccattctagatattaaaataatagtatataccccaaataaaatactcaagtttctgtaaattaaggattatgacttgattatacatattttagatttagagcatgcataaaaaaaaaaaaaaaa

SEQ ID NO: 52034 - DNA, 270 bp, Homo sapiens
ctaagaagaaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaaggtggaagtgggtgaattctactttttatgttggagtggaccaatgtctatcaagagtgacaaataaagttaatgatgattaaaaaaaaaaaaaaaaaaaa

SEQ ID NO: 52035 - DNA, 430 bp, Homo sapiens
aagaattaaaagcctctatgatccagagttgctatgcaccaaattttgatgccttctaaataccttgatgcctgtagcactagaaatgctttcctatttaaaataaacattaaattttaaaatagagctttgtatactatgtaaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatgggaatgggtagccttctgcttactggagatgcacagagaaacatggctgaaaacagctttaaaaaga

SEQ ID NO: 52036 - DNA, 250 bp, Homo sapiens
ctgaatgactactgggtacataacgaaatgaaggcagaaataaagatgttctttgaaaccaaagtttttcctcttcaagactgctcttggcaattctagacctttttatttctatgtgcattttagaattagcttggaaagatttgcaaaatgtttgctgggatttttgttaggattgcattgaatcttcatatcaatttgggaagaataaacatcttaacaatataaaaaaaaaaaaaaaaaaaaaaaa

SEQ ID NO: 52037 - DNA, 470 bp, Homo sapiens
  misc_feature 442, 459: n = A,T,C or G
atgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattggggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggnatcagctctcgcactgnccatctttgca

SEQ ID NO: 52038 - DNA, 420 bp, Homo sapiens
  misc_feature 19, 219, 290, 388: n = A,T,C or G
ggaaaactcggtggtggcncctgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggccgaatcgtaatgnaggcgtgcgccgccaatatgcacctgtacattccacaagcattgccttcttattttacttcttttagctgnttaacttttgtaagatgcaaagagggttggatcaagtttaaatgactgtgctgcccctttcacatcaaagaactactgacaacgaaggcccgcgcctncctttcccatctgtctatctatctggctggag

SEQ ID NO: 52039 - DNA, 236 bp, Homo sapiens
  misc_feature 61: n = A,T,C or G
taacaaatgtggcaattattttggatctatcacctgtcatcataactggcttctgcttgtnatccacacaacaccaggacttaagacaaatgggactgatgtcatcttgagctcttcatttattttgactgtgattattttggagtggaggcattgtttttaagaaaaacatgtcatgtaggttgtctaaaaataaaatgcatttaaaccctaaaaaaaaaaaaaaaaaaaaaaaa

SEQ ID NO: 52040 - DNA, 440 bp, Homo sapiens
  misc_feature 402, 435: n = A,T,C or G
ggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatntgggaggtttggaagatgcccgcatttggattnggatg

SEQ ID NO: 52041 - DNA, 400 bp, Homo sapiens
  misc_feature 392: n = A,T,C or G
aggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttagggaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatatttgtttgcacttaatccttaactgtattaacgttcagcttactaaactgactgcctcaagtccaggcaagttacaatgccttgnttgtgcct

SEQ ID NO: 52042 - DNA, 400 bp, Homo sapiens
  misc_feature 348: n = A,T,C or G
aagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcaccttaacatttttttttgagctaaagtcanggggaatcaagccatgcttaatatttaacaatcacttatatggtgtgtcgaa

SEQ ID NO: 52043 - DNA, 400 bp, Homo sapiens
  misc_feature 348: n = A,T,C or G
gcaatgtaggaggcaagagtaaagcagatgggtacaaccagcctgattccaagcgtcgtcagaccaacaaccaacagaactggggttcccaacccatcgctcaacagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgggnatatactcaagtctttttatttttcctcttttcataaatgctcttggacatt

SEQ ID NO: 52044 - DNA, 149 bp, Homo sapiens
  misc_feature 96: n = A,T,C or G
gcccttgatcccatttctgggcaatttagacagtgaaactgactttgtttacctgcttgcggcatattagaacagacgatccatgctaatatttgnattttctcttaaaacatagctttcctgtaatttaaagggcttttatgaaaata

SEQ ID NO: 52045 - DNA, 430 bp, Homo sapiens
  misc_feature 30: n = A,T,C or G
gggaaaacagtgtggagattccttaaaagnaactaaaaatagaactaccaattctatttttataccaattgctggattgatccagcaatcccactactgggtatctgcccaggggaaaataagtcattactcgaaaaagatacttgcacatgcatgtttatagcagcacaattgtaaaatcatggaaccaacccaaatgtccaccaatcaacaagtggataaagaaactgtggtatgtatttatgattgaatactactcagccataaaaagaaatgaatcaaccacattagcagtgaccctggatgagttggagactattattctaagtgaagtaactcaggaatggaaaaccaaacatcgtatgttttcactgatatgtgggagctaagctatgaggatacaaaggcataagaatgatgcaatggactt

SEQ ID NO: 52046 - DNA, 432 bp, Homo sapiens
  misc_feature 386: n = A,T,C or G
attgcaataacagttgatactcattttaggtaccaaaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgnggttgtcatatttggcttttgctatatactttaacttcattggtaa

SEQ ID NO: 52047 - DNA, 450 bp, Homo sapiens
ctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccagga

SEQ ID NO: 52048 - DNA, 223 bp, Homo sapiens
  misc_feature 6: n = A,T,C or G
tatganttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaaaaaaaaaaaaaaaaa

SEQ ID NO: 52049 - DNA, 330 bp, Homo sapiens
tttgcaggacaggccaggagaatggtggatccttttcataccttatttggaattgctggattgtcacttttgggagaagaacagattaaacctgttaatcctgtcttttgcatgtctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgcaaaaaaaaaaaaaaaa

SEQ ID NO: 52050 - DNA, 468 bp, Homo sapiens
  misc_feature 5, 434, 442: n = A,T,C or G
taggncaatggttatcatttttcctaaaatctaaacctgtagacaacttgagggatgactgataatacactaaacataaatgaagaattaaaattcagttaagcaattctggtgtccctaaggtactctgatatttttgtgtgtagctaattggtcaaaaaataatgaaaacaataacttaaatatgtgtagcaatttatggtttcaagtaccatcatatttagttggtttgatcctcacaccgtcaatattacagaagttcatgcaaggtgagtaattggccttaggcaaaaacaactaattaatattaaagacagaattgaaagataccttgttatttctctctcagttaaggtcttttaaccatcaagtaaggagagaagaggaaaatcaaaactaaaatgatagagtatctaaaaagttaatggaagggnaaacttcnttattaaaaactgcgctcctcaatga

SEQ ID NO: 52051 - DNA, 300 bp, Homo sapiens
  misc_feature 204, 249, 282: n = A,T,C or G
aagattcccgagagtaaatcatctttccaatccaggaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggntttctcataaatgagggctgcacattgcctgttctacttcgaagnattcaataccgctcagtattttaaatgaagggnttctaagatttgggttgg

SEQ ID NO: 52052 - DNA, 420 bp, Homo sapiens
  misc_feature 5: n = A,T,C or G
caagnagtaggggaatcaaagcaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacgcctacactaatagtctgtctcaacaatgagtaaaggaacttaagtattggtttaatattaaccttgtatctcattttgaaggaatt

SEQ ID NO: 52053 - DNA, 220 bp, Homo sapiens
  misc_feature 7, 181, 197, 212: n = A,T,C or G
ggatgtngctttgggatcaggtgccactggtgtctttaccaattcatcctggctctggaacaaactcttcgaggccagcattgaaacaggggaccgtgtctggaggatgcctctcttcgaacattatacaagacaggttgtaggattgccagcttgctgatgttaacaacattggaaaatncagatctgcgggagcntgtacagctgcggcnttcctgaa

SEQ ID NO: 52054 - DNA, 397 bp, Homo sapiens
  misc_feature 289, 355, 362: n = A,T,C or G
acatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggncaacctcaagggcacctttgccacactgagtgagctgcactgtgacaagctgcacgtggatcctgngaacttnaggctcctgggcaacgggctgggctgtgtgcctgg

SEQ ID NO: 52055 - DNA, 440 bp, Homo sapiens
  misc_feature 6: n = A,T,C or G
taatgntgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagt

SEQ ID NO: 52056 - DNA, 410 bp, Homo sapiens
  misc_feature 9, 364, 370, 381, 403: n = A,T,C or G
agatccagnaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgcctgactttctcttcctttgagcctgcatcagttcttggttttgcctatctacagtgngatgtntgggctcaatnaaaaacattaaacgcaaactgnttaggat

SEQ ID NO: 52057 - DNA, 440 bp, Homo sapiens
  misc_feature 7: n = A,T,C or G
attgccngcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaaggaacaataatgatgagatttgtaactgtcaactattaaatacattgattttttg

SEQ ID NO: 52058 - DNA, 199 bp, Homo sapiens
  misc_feature 39: n = A,T,C or G
ctctaaatccccttgtaaatttaactgttagtccaaagnaggaacagctctttggacactaggaaaaaaccttgtagagagagtaaaaaatttaacacccatagtaggcctaaaagcagccaccaattaagaaagcgttcaagctcaacacccactacctaaaaaatcctaaaaaaaaaaaaaaaaaaaaaaaaaaaaa

SEQ ID NO: 52059 - DNA, 332 bp, Homo sapiens
aaggaaaaaacctaccgtatatctgtagctacattaaaaacattcaagaattggccgggcacggtgactcacacctataatcccagcactttgggaggccaaggcgggcagatcaccaggtcaggagttcaagaccagcctggccaacatggcgaaaccccgtctctactaaaaatacaaaaattagctggacatggtggcaggccgccagtaatcccagctactcgggaggctgaggcaggagaatcgtttgaacctgggaggcagaggttgcagtgaaccaagattgcaccattgcactccagcctgggcgacagggtgatacctccgta

SEQ ID NO: 52060 - DNA, 300 bp, Homo sapiens
  misc_feature 235, 256: n = A,T,C or G
tctcaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtnaatttagtgtttttttatttntactgtcaaatgatgggcaagaccttttactgggtgcctgggaa

SEQ ID NO: 52061 - DNA, 160 bp, Homo sapiens
  misc_feature 6: n = A,T,C or G
aatctngagtttgctttactggttcagcaaaagccaggaagaacaactttgtagtaatcaaaatgttatccaactgtatattgtttactttattgtaaatactggtgaacagtggttaataaatagtttatattcctttaaaaaaaaaaaaaaaaaaaaa

SEQ ID NO: 52062 - DNA, 370 bp, Homo sapiens
  misc_feature 190, 269, 276, 279, 344, 361: n = A,T,C or G
agagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacangaatacatacttattcccatttttaagcatttgcttctgttttccctacctagaatgtcagatgtttttcagttatctncccattngtnaaagttgacctcaagataacatttttcattaaagcatctggggtctgaggacacaattattattntaacaatggttattagntcattcact

SEQ ID NO: 52063 - DNA, 350 bp, Homo sapiens
  misc_feature 314, 346: n = A,T,C or G
cttcctttctgggctcggacctaggtcgcggcgacatggccaaacgtaccaagtaaaatcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtngacgctcctctactctttgagacatcactggnctat

SEQ ID NO: 52064 - DNA, 330 bp, Homo sapiens
atgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgtaaaaaaaaaaaaaaaaaaaaaaa

SEQ ID NO: 52065 - DNA, 374 bp, Homo sapiens
ggcggcctcagcagcgcgaggtgctgcggcgctgcgtagaaagtatcaatcagccggttgcttttgtgagaagaaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactaaaaaaaaaaaa

SEQ ID NO: 52066 - DNA, 318 bp, Homo sapiens
  misc_feature 13: n = A,T,C or G
aacagctatcagnatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttctg

SEQ ID NO: 52067 - DNA, 530 bp, Homo sapiens
  misc_feature 8: n = A,T,C or G
agagcagnagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcatcatgtaaataatttccatatttctcttttataataaactaatgataactaatgacatccagtgtctccaaaattgtttccttgtactgatataaacacttccaaataaaaatatgtaaa

SEQ ID NO: 52068 - DNA, 279 bp, Homo sapiens
  misc_feature 142: n = A,T,C or G
aggcccatgcggtggttcatgcctgtaatcccagcactttgggaagccaaggcatgtggatcatctgaggtcgggagtttgagaccagcatggccaacatggggaaaccctactaaaaatacaaaaattggccagccgtggnggcatgtgcctataatcccagctacttgggaggctgaggcaaggagagttgcttgaacctgagaggcggtgattgcagcaagccaagattgtgccattgcactccagcctgggcaacaagagtgaaactcttgtctc

SEQ ID NO: 52069 - DNA, 400 bp, Homo sapiens
taacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtggtggcagttacctaggggaattctgcctctgactgttctttttcttttggtctttaaacaccctgtcgtgggatgtgctcactgatttgtggctatgtttgaaggtatcacttgtcttgagggttttcaatatttcaggatcatgctggtggcaaaaaggactccatgcctctgtggaatcatgtccacagggggacctgcctcccgtgatgtcccacctttccttcaaggtctgtcatatga

SEQ ID NO: 52070 - DNA, 164 bp, Homo sapiens
  misc_feature 6: n = A,T,C or G
tatacntaaacataagatttgtaatgtttcatttataaactgccttcttcaacacatgttaatagtgttttctcaaagtattgatagtatgtcttccagaatttcacaatatgcttacagtaaatatttcctagcttgttgaaatgttaaaaaaaaaaaaaaaa

SEQ ID NO: 52071 - DNA, 210 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaggaaaaaaaaaaaaaaaaaaa

SEQ ID NO: 52072 - DNA, 460 bp, Homo sapiens
ataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgttggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaa

SEQ ID NO: 52073 - DNA, 500 bp, Homo sapiens
  misc_feature 498: n = A,T,C or G
attcctcacaaattatacctgggataaaaactatgtagcaggcagtgtgttttccttccatgtctctctgcactacctgcggtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggattttgatgactggtattaagaggtgacaatgtaacccgattaacaacagacagcaataacttcgttttagaaacattcaagcaatagctttatagcttcaacatatggtacgttttaacctttgaaagttttgcaatgatgaaagcagtatttgtacaaatgagaagcagaattctcttttatatngg

SEQ ID NO: 52074 - DNA, 500 bp, Homo sapiens
tagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggacctgtcagttcttgggaaagtggtcagcgcatcctgcagggcttctcctcctctgtcttttggagaaccagggctcttctcaggggctctagggactgccaggctgtttcagcccaggaaggccaaaatcaagagtgag

SEQ ID NO: 52075 - DNA, 159 bp, Homo sapiens
catgcttattaaggaaggttaaaaaacgtaaaaggaaactcggcaaaatctttctcccgccttgtttccaaaaaacaatcacctcttagcatcaccagtatttagaaggcacccgcctgcccagtgacaacgaaaaaaaaaaaaaaaaaaaaaaaaaaa

SEQ ID NO: 52076 - DNA, 480 bp, Homo sapiens
aatgttcaaagccgagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcaagtgttgaagaaagtgcaaaaggaacttttatatatttgacagtgtagggaaattgtctattcctgatataattacctgtagtactcttgcttaaggcaagagtttcagatttactg

SEQ ID NO: 52077 - DNA, 410 bp, Homo sapiens
ctactaggtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgttttggaggagcaaagttaaaagcctaccta

SEQ ID NO: 52078 - DNA, 400 bp, Homo sapiens
  misc_feature 59, 221, 317: n = A,T,C or G
acagttttttttttaattggcagcaccactaaccattccttacattcttttttgtatgnggggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgtngggatttttttgtttttcaattggcaacaaaagctctgtagggctgcagacatttaaagttcacataatcatctgtaagacattatgtatttttgnggaaatactagaatttttttcctgattttgccattatatgggatttgctatttttttgattaatgcaaaagtatatgactttg

SEQ ID NO: 52079 - DNA, 302 bp, Homo sapiens
attctgggaaatgtatgccctgctttgaagtagaagcaggaaggtcagagagcccttcctgcatctgctgcttctcaattgccttcagcccaaaataactaatataccaaagtggcataattggaggtggcatgttctgatccccttaaccatttattaattattttgaagtgtataaaagtatcaatcatatgtcattatttaatgaagaaaagaacaaatgctttgcttccacataggtattattaacaacaattaataaagtgactgtatcataaaaaaaaaaaaaaaaaaaaaaaaaa

SEQ ID NO: 52080 - DNA, 450 bp, Homo sapiens
aattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgtttttggatgccccctaatccccttctcccctgcactgtaaaatgtgggattatgggtcac

SEQ ID NO: 52081 - DNA, 260 bp, Homo sapiens
attggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatacaaaaaaaaaaaaaaaaa

SEQ ID NO: 52082 - DNA, 410 bp, Homo sapiens
atgtggctgcggcatcgccggcctcgctatgattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatggttattggaccaatgttctgtataaacaattaaagatgtaaccatttaatagtctgtaacaatcaaccctcagtactgtcactacaatattacattctgcaaatgttattctgttggatcagatacaa

SEQ ID NO: 52083 - DNA, 270 bp, Homo sapiens
ttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgaaaaaaaaaaaaaaaaa

SEQ ID NO: 52084 - DNA, 295 bp, Homo sapiens
ccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttgggaaaaaaaaaaaaaaaaaaaaa

SEQ ID NO: 52085 - DNA, 400 bp, Homo sapiens
  misc_feature 226, 309, 390: n = A,T,C or G
aacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgttttnggattgccacacggctcacattgcatgcaagtttgctgagctgaaggaaaaagattgattcgccgttctggtaaaaagctggnaagatggccctaaattctttgaagtctggtgatgctgccatttgttgataatgggttccctggcaagcccatgtggtgttngagagcttct

SEQ ID NO: 52086 - DNA, 201 bp, Homo sapiens
  misc_feature 26: n = A,T,C or G
aactgtactggctgttgaccaccagnacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaaaaaaaaaaaaaaaaaaaaa

SEQ ID NO: 52087 - DNA, 226 bp, Homo sapiens
ttcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaaaaaaaaaaaaaaaaaaa

SEQ ID NO: 52088 - DNA, 177 bp, Homo sapiens
  misc_feature 8: n = A,T,C or G
actgtccntgtctgggtgtgtgcctattacctcagcatttctcacaaagtgtaccatgtagcatgttttgtgatataaaagggagggtttttttaaaaatatattcccagattatccttgtaatgacacgaatctgcaataaaagccatcagtgttaaaaaaaaaaaaaaaaaaaaa

SEQ ID NO: 52089 - DNA, 228 bp, Homo sapiens
  misc_feature 154, 217: n = A,T,C or G
ctaggtaaagttgtatggatataactatagtacacctctattttacttttggcagaatatgagcaactgaagaacttgctttataatctaacatttatttttaaatctcaagtatcatcctactggagttaaattaccttgcacttttccttgnattactcttgttttctaaacgtgtaatgaaataaaaaggaaaattgactgttaaaaaaaaaanaaaaaaaaaaa

SEQ ID NO: 52090 - DNA, 253 bp, Homo sapiens
attctccaggcgtacgcgaataacaactcggataaccattgttagttaatcagactataggcaataatcacactataaataatccacctataacttctctgttaacccaacaccggaatgcctaaaggaaagatccaaaaagataaaaggaactcggcaaacaagaaccccgcctgtttaccaaaaacatcacctctagcattacaagtattagaggcactgcctgcccagtgactaaagtttaacggccacg

SEQ ID NO: 52091 - DNA, 440 bp, Homo sapiens
tgcataagacagtctctgtagttgcctctcatgtgcccagtaagtgcccaagtaatttgtcagtttgggaaatgaagcgaagtcttcaacagccattcacactctccaggtgggtaatacacaagtgtgctgcacacgtgcattttgaacagttttctgactaccgttgttctctggctttgccttcagaaaacccgctatgaaatgtatgtcagcattctcaaggaaggaggcaaagagctactgagtaacgatgaaagcgaggctgcaggactgaagaagtcgcacttcgagtccttcgctgaacccggatacttctccaatcactgccaaagtcaagcgtaacgtgtcagagaggaaggatcaccgacctgaaacaccaagcattaagcaaaaagttactttagagtccatctgcggcaggaagtgctggtcatgga

SEQ ID NO: 52092 - DNA, 400 bp, Homo sapiens
aaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatt

SEQ ID NO: 52093 - DNA, 410 bp, Homo sapiens
aacgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaact

SEQ ID NO: 52094 - DNA, 440 bp, Homo sapiens
  misc_feature 9, 32: n = A,T,C or G
aacctgaanaaccttccgcattgattcttgtnaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagccctgaaaggactgaataatttggctta

SEQ ID NO: 52095 - DNA, 181 bp, Homo sapiens
  misc_feature 13: n = A,T,C or G
catgtgactgtcntaaattaaaaaaattaaaaccaccttagaataagaaatgaatagctatagggccaaattgtgaaacacattaaaaaatcctttcataagaatgaagtaggtcatttctaaatgagttttccaccttttaaaagtacgtaccccgtctctactaaaaaaaaaaaaaaaa

SEQ ID NO: 52096 - DNA, 295 bp, Homo sapiens
ctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaatttttgtttctgtactttttggcataacataaatctgtgaacttgaaatttgaattttgtgttagagat

SEQ ID NO: 52097 - DNA, 196 bp, Homo sapiens
  misc_feature 133: n = A,T,C or G
ctataagtagttggtttgtatgagatggttaaaaaggccaaagataaaaggtttctttttttttccttttttgtctatgaagttgctgtttattttttttggcctgtttgatgtatgtgtgaaacaatgttgnccaacaataaacaggaattttattttgctgagttgttctaaaaaaaaaaaaaaaaaaaaaaaa

SEQ ID NO: 52098 - DNA, 312 bp, Homo sapiens
caagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattgtaaggcctttcttttaaaaaaaaaaaaaaaaaaa

SEQ ID NO: 52099 - DNA, 256 bp, Homo sapiens
aattttgttggggtgatagtgagatagtgagagactaaacctcttattacttgcctgacagtatgttgaaattttaatattatctcatttgattccttcaaaaactgttacttagcaccattttatggatgatgaaacagactgaaacagtttaaacaacgggtgtagaactaggtgggaactaggttagctttactctaaaatgcatgcaataagtgcccatcagagtatgtatttgaaaaaaaaaaaaaaaaaa

SEQ ID NO: 52100 - DNA, 450 bp, Homo sapiens
  misc_feature 11: n = A,T,C or G
agtcctcgaangctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatgggatttccgcacacaactgataaggctctgttacagctctgaccacgaaaaactgaagcctcagtacttgggaagagctacctggacaactgaa

SEQ ID NO: 52101 - DNA, 413 bp, Homo sapiens
  misc_feature 12: n = A,T,C or G
ctaaattctttncttggcatgtaaggcttttttccagttccacctcaatcttcctcatcaggttcttacataggaccaggactggatctcaagaaaaactcttctgaagtcacatgcagataaattctcactgtcagaccaggtggcggtgtctcacacctgtaatcccagcactttgggaggccgaggtgggtggatcacctgaggtcaggagtttgagaccagcctgaccaacatggtgaaaccccatctctacaaaaatataaaaagtagccaggcctggtggcgggtgcctgtgatctcagctacttgggaggctgaggcaggtgaatcacttgaacctgggatgcaggagattacagtgagccaagatcatgccactgcactccagccttgggtgacagagcgagatt

SEQ ID NO: 52102 - DNA, 300 bp, Homo sapiens
taggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctagttgtcatttatatgcctaactggagctagtactttaattcttaacacaaaattactctgccattgtttccagcttccctcctacaatagaatgaagtttttttgatggcttgagatggctcacaaattttgatttttttttcttccttgt

SEQ ID NO: 52103 - DNA, 380 bp, Homo sapiens
  misc_feature 17, 41, 49: n = A,T,C or G
aagcttgaccagaaganctgctactttctaactggtcagantgtggaanttttaaagatctgaaaaagggatcaaataggaattaattcttaaatagaaatgatgatatcagactttcttttttaaaaacatgaatttaatgactgatgtagagtgtcagttgagtatcattttttaagttgaatggatgagaatatcaaagctgtttaccaaaattaaaaatcaaaagttcttattttgggagaaaagtgatgagtttaacttagaacagtaaagtttgaggtgttgacaaggagggtacaaatagctctgtttacgctcaagcactggtttcatattacgggggttttctttgctgtatactatccatcaattgtgtt

SEQ ID NO: 52104 - DNA, 350 bp, Homo sapiens
  misc_feature 320: n = A,T,C or G
aaagcaggaacttttcctgaagttgcaatttactactgtatggcttcttttttcctgtttcactctaggtttttagaagtgaagtatagtaaatttggttcgttaaattgtgaaggcgctggaattacatgaacataccaccctagtaaaaggcaagttctgtaagcttacattgctatttgtaaagtttgccttcacagcatttcagatgctgttggacttcatgtccccaacctagcttggtgagggctgtaactgtttccaagtacttgtacatttggaagtctgaatgtgtaacaatatttaatgattttaagagntcctcatgttgcagggtttaagaaatctga

SEQ ID NO: 52105 - DNA, 280 bp, Homo sapiens
aaatacccaattttttttcctctaataaataaattattttaagaggaaactttttccccttgagacaaagccccttgcattggggaagtggtccccatttaaaatggcttcattttttcattctgtgccttgttgcttttccttgcagattcccattggatcaatagagtgcctcaggataaaagtatcctagaacagccattctcaaagtgtagtccttggacctctgtaggtccccgtgaccattccaaagggtccgtgacatcagaactcatctgta

SEQ ID NO: 52106 - DNA, 400 bp, Homo sapiens
cctacaaaagtttgatagctagaactactttcagggccctgagaattttgtactttggagaataaccttttctagccctttataccactattgcacttagtgcaaattgattaatatttggagttacagcttctgttttgttttgtattgttttttgagacaagatcttgctttgtcacccaggctggagtacagtagcacagtcacagcttactgcagtctcagctgagttttggattctaaaatataagaagatcttctcagcttaagcatcctattgccaccatgcttgggatcttgtacaggtcttatttcagaggagctttgataggtttcagtcacaaaatactattactgtctttattttgtaaacaagctttatgcctttgataatttagca

SEQ ID NO: 52107 - DNA, 420 bp, Homo sapiens
  misc_feature 10, 14: n = A,T,C or G
cagccttgcnagcntgtgtgggctgggaggtctggtagggctgagcttgcaagaggatcaacactgcctttggctagagatttacttacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaaggttgttcaacagtgttgtgccagcctacaggaggaaaggccagactcacagaagggtgttcatttagaagaaagcaacactaatgattcaaacagcttcctgaattttaattttgtggttgtctcacagaaagccttatcataaattccataattctaattaatttaccaagataatgaatta

SEQ ID NO: 52108 - DNA, 151 bp, Homo sapiens
  misc_feature 19, 105: n = A,T,C or G
agcgatagcattgggaganatacctaatgctagatgacgagttagtgggtgcagcacaccagcatgtcacatgcatacatatgcaactaacctgcacaatgtgcncatgtaccctaaaacttaaagtataataataaaaaaaaaaaaaaaa

SEQ ID NO: 52109 - DNA, 180 bp, Homo sapiens
  misc_feature 8, 16: n = A,T,C or G
tctgccantaaagacnggtgttgggttaggttacactctggttacttgtcctgggaaaatcctttttctagagatggccttccaagtggttttaaaatttactgaagtttttaggtcaattatgtatgttgactaaatttacaaataaacttgtttatcgaaaaaaaaaaaaaaaaaaaa

SEQ ID NO: 52110 - DNA, 365 bp, Homo sapiens
  misc_feature 22, 45: n = A,T,C or G
tttgaggaagagcagctgtctntttcactgttttttgacaaatcntacttgtattcttttgtacaaaaaagaactacttgtattctagaagaaatatgaaatgcttaatttattaagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttca

SEQ ID NO: 52111 - DNA, 280 bp, Homo sapiens
  misc_feature 61: n = A,T,C or G
tgcacttgttttcgtttttaactggaacctttagaaagaaggaaatgaatgtgcattttanttaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatggagtttatacattctattt

SEQ ID NO: 52112 - DNA, 354 bp, Homo sapiens
  misc_feature 33, 47: n = A,T,C or G
caggcaaatcagtttcttgggctctgccaggcnaatcttctcaaacntctcagtacctgaccttcaaaaatgatcacactgtaatttccaaaaggtcacaagacatgactctcctaaacacaggacgaggactttatttcaactcattaattaatgaggaaaacaataaaatgaaaactgactccaagagcatttgagaagctgggtaattcttggcaacattaagattactaggttgaaggttgcacatttatttattatgttcaatactttggttcttagttcttaaagaatcaagaagttgtgtaatcttttaaaaatatcttgcaggtaaaaaaaaaaaaaaaaaaaaaa

SEQ ID NO: 52113 - DNA, 360 bp, Homo sapiens
  misc_feature 24, 33, 78, 116, 303, 329: n = A,T,C or G
tcctggatgttgatgtcctgcatntaacgcggngtaacccccgagccgagcgagctccgggggaatttcagtatctgntacggtaacttcatcagcccgccaagatggcgatgcangcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacntctttgatgccaagaatgcatgtgancacctatcgggattcaatgtttgtaacagat

SEQ ID NO: 52114 - DNA, 330 bp, Homo sapiens
  misc_feature 83, 87, 108, 122, 149, 191, 216, 220, 241, 284, 302: n = A,T,C or G
aatctgtgggagcagtttattccagtatcacccagggtgcagccacaccaggactgcgttgaagggtgttttttttttctttnaaangtaatacctcctaatcttttnttcttacgcagggnctgagaacatttacattatagataagnagtacatgggggataacttctacttttaggaggactactctnttctgacagtcctagactggtcttntacnctaagacaccatgaaggagtntgtgctcctattattcctggctttgggctctgccaaacccttntttagcccttcacacatngcactgaaaaatatgatgctgaaggatt

SEQ ID NO: 52115 - DNA, 400 bp, Homo sapiens
  misc_feature 22, 27, 47, 392: n = A,T,C or G
gcatttaaagcctggaggaacnagacncttagctgttgccgtcacantgcttagacaccagtttactttaagcgtgttatgaccttcctcacccctactaaccaaatttaaatgggtcccgacttcaccctctggaaggaagtaaactcttctctccccatggtttcagagcagtttttacctgcaagcaccatctctgtatgtgctcttactagattatacagttcttgagagggattgcatctttggtgtttttgtatttccacctcacccccagcacatagcccagtctcttgcacaaattaagtacttaatgtgtgttgagctaaattgaataaagggattattagcattagcatatttttgtgccttggttgtataagctgggttgnttggtttg

SEQ ID NO: 52116 - DNA, 208 bp, Homo sapiens
  misc_feature 63: n = A,T,C or G
agttccagacgacgctaaaataaatcttgttaaaagctttacctctagggaatgggatttagntttaaaaagggtgggatgggaaactgtgtttttcattttaagtccttctgtactatttaattttttaccttgtgcatgtattactttgaaaaaatttttaataaacccaaataaaaatcttaaaaaaaaaaaaaaaaaaaaaaaa

SEQ ID NO: 52117 - DNA, 440 bp, Homo sapiens
  misc_feature 23, 40: n = A,T,C or G
acgttgtctgcaggcactcagantggtccagcgcttgacntaccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaagacgctgtaaaaaaaaaaaaaaaaaaaa

SEQ ID NO: 52118 - DNA, 341 bp, Homo sapiens
  misc_feature 119, 255, 259, 267, 268, 269, 270, 272, 278, 280, 283, 285,286, 287, 297, 299, 300, 301, 303, 315, 317: n = A,T,C or G
tttggaagaagctgcaggcttattccccatgcacttgcttcctggctgcaaaccttaatactttgtttctgctgtagaatttgttagcaaacagggagtcctgatcagcaccctttctncacatccacatgactggtttttaatgtagcactgtggtatacattgcaaacatccgttcaaaatctgagtcggagctaaaaataaaaaatgaaaaaacagaaaaaaaaaaaaaaaaaaaaaaaaaattttgggggncccntgggcccnnnngntttttnanttngnnnaatttttttntnnngncccaatttgggncnccttgcattttcccccattggggg

SEQ ID NO: 52119 - DNA, 345 bp, Homo sapiens
ttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgttttggttttccgaaaaaaaaaaaaaaaaaaaaaaaa

SEQ ID NO: 52120 - DNA, 420 bp, Homo sapiens
gttacagaaagttggctgagcacggtggcttacacgtgtaatcccaaagtgctaggattacaggcgtgagccaccgcgccttgtttgtttgttttttggagacagagtctcattctgtcacccaggtcactctcactcaacagcaactgatgcaattcttccaaatcccagtacatttcagcatcccattcagttgtaattctgtaaaacaactttcatccctcctgaatagtaactgctaaactgaaggttacttagttgaccgctttcattaaagcaggccttttgtagagtagcccaagttgaaatttttgctgttttttcttgatcattctagatttagttttacctacttcctctcccagaaggttgaagaaaaaagtggttaagaaggtgattaaatctggaagggttcagatg

SEQ ID NO: 52121 - DNA, 257 bp, Homo sapiens
  misc_feature 70, 105, 107, 114, 141, 146, 201: n = A,T,C or G
aggctttgaggcagcccgcgcaggggctttctgctgagggggcaggcggagcttgaggaaacccgcaganaagtttttttctctttgaaagatagagatttaatncnaactacnttaaaaaaactagtcaataggttactnaaganatttgctttagcgttaagtttttaacgtaattttaatagcttaagattttaaganaaaatatgaagacttagaagagtagcatgagaaaaaaaaaaaaaaaaaaaaaaaaa

SEQ ID NO: 52122 - DNA, 370 bp, Homo sapiens
  misc_feature 15, 20, 98: n = A,T,C or G
agctgcttctaagangggancccccaatttaattaaagccttaagcacaattaattaaaagtgaaaacgtaattgtacaagcagttaatcacccaccntagggcatgattaacaaagcaacctttcccttcccccgagtgattttgcgaaacccccttttccctttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatatttgggggttggtgcaggcattaaaaaaaaaaaaaaaaaaaaaaaaaaa

SEQ ID NO: 52123 - DNA, 400 bp, Homo sapiens
tttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaaggggttttgaacatgaaatgacaaaaacaacagcaagaagaaaattcttgtcctttttcattactatcaga

SEQ ID NO: 52124 - DNA, 223 bp, Homo sapiens
gtgggcgcgtattgtggaatgggaggaggtcgcgctgtccattgggcgtccctttggcctgcgccaccccagagatgataaaatagccgaagacgtcaatggcacccatggacatagtaagcatagtaggagctgaaaactagaagcaatgacaatgtcaactatttttgagcaaaaagaagcagtgtcttcggaacatttgatcaaaaaaaaaaaaaaaaaa

SEQ ID NO: 52125 - DNA, 230 bp, Homo sapiens
  misc_feature 35, 58, 80, 82, 108, 111, 184, 205: n = A,T,C or G
actatggataaggttagaatgtcttactgtctggnaaactttgagctttgcggctagnagggctgctccttggagccagngnagagctttctttttactatggcactncgnattcctttgcacagcatcatatgtcatcatttttggcaagatggcagctaattaacaaaaatgtgtgaagcanccatgtttgggacagtggggngaaatggagtatgggatttggaagt

SEQ ID NO: 52126 - DNA, 380 bp, Homo sapiens
  misc_feature 31, 57, 289, 346, 368: n = A,T,C or G
tctcaccattgttgacattgacaaacggaantacttggttccatctgatatcactgnggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcacccgtaactgcttgtgtatcttgtnaatagccagccattttcagttattataccaggaacctcttcacatagacctattagngcatttgtaacctggatttatntcttaatatatt

SEQ ID NO: 52127 - DNA, 400 bp, Homo sapiens
  misc_feature 25, 260: n = A,T,C or G
cagagtacgagtctgaggcggaggnagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggnggcaccaaagtagttctagatgacaaggattatttcctatttagagatggtgacattcttggaaagtacgtagactgaaataagtcactattgaaatggcatcaacatgatgctgcccattccactggaggtctgaaatc

SEQ ID NO: 52128 - DNA, 283 bp, Homo sapiens
aaggtataaaaacaaaggaggaataattccattgaaccttgattctggaaactttgatccacccagcagtcatgatgttagactcattgaatagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaag

SEQ ID NO: 52129 - DNA, 184 bp, Homo sapiens
gtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccattctaaaaaaaaaaaaaaaaaaaaaaaaaaaa

SEQ ID NO: 52130 - DNA, 102 bp, Homo sapiens
  misc_feature 24, 28: n = A,T,C or G
gctgaagagaaaaaaaggtcgggngacnggagcttggagaacagaagtgtttcagagtcaagtagagaaaaagaagccccacaaagataagaaaaggaactg

SEQ ID NO: 52131 - DNA, 391 bp, Homo sapiens
  misc_feature 43, 58: n = A,T,C or G
atggaccgggcaccacacatcggctctgactgggacacaggtnggaagccctaggaanagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgggtctttttttccttttctctcttttaaaccatgcattataacctttgaaacc

SEQ ID NO: 52132 - DNA, 140 bp, Homo sapiens
  misc_feature 14, 37, 64, 72: n = A,T,C or G
atgatggaagtggngcaaggcaaaggatttggtgtgncctgcttttcctcttttgaagaggctnccacagcngtgggtgagatgaatggccgcttagtgggctccttgcccctgcttgtcgccctgcgccaggccaggcg

SEQ ID NO: 52133 - DNA, 115 bp, Homo sapiens
gcgtcggtagctcacgcctgaaaacccaacactttgggagaccgaggcgggcggatcacctgaggtcaggagtttgagaccagcctggcccacatggtgaaaccccatctctact

SEQ ID NO: 52134 - DNA, 330 bp, Homo sapiens
  misc_feature 95, 264: n = A,T,C or G
ggaccatcacttgtgcacccactttgactatgagtataccaccacattgcatttctgtttgcaccatgtcttccaggagactagactactggtgnccagggtcaatttgagtgtaaagaaaatgtagacaaggaattgcccaattttaaattctgactttgctgacttaatttaaatgctcgttctgaaccaattttcccctatcttctctaggggtttcaaaagactcagttaattgatttccaggaagtactcatagcaagntcataaaagttcttgagacctaaatttcttcacaaaaaaagaaaagaccttaagtcatacatttta

SEQ ID NO: 52135 - DNA, 353 bp, Homo sapiens
tctcattttatacctcactgtccttctggctaggagtcatatgatgctcctttaataaaagaaaaaaatgtatccttgaagtcacagaatcagaatcagaattcaaacccaggactctctggtttccaaggcctttttaatttcacttgaccccacatgactaacattggcaagtcaaggagaggttggaatgcttacatcatctgttttcataagtaatgtgagttcatgagatgggagatatcttagaccatatgaagaatagcccatgttcattgtgaacatcttttaaggttccagagaaaatagaaaatgtcaaaacctacgggttgtaaaaaaaaaaaaaaaaaaaa

SEQ ID NO: 52136 - DNA, 313 bp, Homo sapiens
  misc_feature 242: n = A,T,C or G
tggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgcagcaattcagggctcttcaaacttgnttgatataaaatatgttgtcttttgtttaagcatttattttcaaacactaaggagctttttgacatctgtt

SEQ ID NO: 52137 - DNA, 229 bp, Homo sapiens
ggaaagagttaacctgtcacattgcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattatgccaaaaaaaaaaaaaaaaaaaa

SEQ ID NO: 52138 - DNA, 250 bp, Homo sapiens
  misc_feature 16: n = A,T,C or G
acttaccttctttaanagaataatgtggccattagccttcggttctggcctgggattaggaatggcttattccaactgtcaccatgttttccaggctccatatcttctacatgtaaaatatgtcaaagagcaggagccgtgacttcacctgagaacatcccagcgctaggacaagataaatcatgtttattcctcaggaatactgaactgccctggtagtaagctgccattccttctgtaacatgtggtt

SEQ ID NO: 52139 - DNA, 500 bp, Homo sapiens
  misc_feature 2, 26, 57, 71, 117, 139, 152, 161, 180, 198, 221, 241, 248,268, 312, 318, 330, 362, 406, 419, 456, 483, 493: n = A,T,C or G
anattactataatgggcacaatgtanacttcttgggtgatggatatactaaaatctnagatttcaccattntgcaatatatcagtataacaaaactgcacttgtactccttaaattnataaaaaatatctaaacattgnaaagttacagtangtatataantattgtaatcttacagggncacagtcatatatgtagnctgcttttgaccaaaattaggcngtgcatgactatactggcanaaggatngacagagaaacagaactgantagagtctagaaatagacctacacacataaaatcagttaatttncaatanagaagccaaagnaattgaatagggaatgccaaaataattgaatntccatataaaacatgttaaagtcttatatgattaccgatatgcntttatcatatacntaaatttactcatagatctaaagggataaaaccttgntgaagaaattatatggggaaatcatcncccaaactgnggcagta

SEQ ID NO: 52140 - DNA, 110 bp, Homo sapiens
taagactaaggcccttacataaaagcactgagacatgaaaacccacaaacacttagtgaacatgctaagcaccctaatcaactggcttaaatctacttcgcccgccgccg

SEQ ID NO: 52141 - DNA, 360 bp, Homo sapiens
  misc_feature 28, 321: n = A,T,C or G
agatattgcaccctatgacattgggggncctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccaggtatttatttccaaaatgtttggaaacagtataatttgacaaagaaaaatgatacttctctttttttgctggtccaccaaatacaattcaaatgctttttgttttatttttttaccaattccaatttcaaaatgtctcaatggngctataataaataaacttcaacactctttatgataacaa

SEQ ID NO: 52142 - DNA, 139 bp, Homo sapiens
taaagggggactgcaaaggccaactgttggtgctggcaaaaaagccgaaggagtaaaggtgctgcaatgatgttagctgtggccactgtggatttttcgcaagaacattaataaactaaaaacttcatgtgaaaaaaaa

SEQ ID NO: 52143 - DNA, 180 bp, Homo sapiens
cagacggcatgatgtacctgatactgaggaagcgcaaatagagttccggagctgggttgcttctgctgcagtacagaatccacattcagataactcattttgtatataatcattattttttgaggtttttctagcaaacgtattgtttcctttaaaagcccaaaaaaaaaaaaaaaaaaa

SEQ ID NO: 52144 - DNA, 122 bp, Homo sapiens
ctgtaaatgccagccctttgggtatgccgaatgggcagatcacttgaggccaggagtttgagaccagcctcgccaacatggggagaccctgtctctactaaaacgataaaaaaaaaaaaaaa

SEQ ID NO: 52145 - DNA, 320 bp, Homo sapiens
acaagcatcttttgaggaaaacacaataccttactcacccccactcagattaaaataatcaactactgataaatatcttacacaaaaaccacctctgaataagtcttttggcaaccatttgaaatgcaaactcttgtatgacatattttggaactaaagataagaagagaggggaaaaaaaagcagctcttctgtggctgtgaagctcaaaaagaatatattaattaacccaagagaatttctaggaagctgtagtgagaaactgtagctttgaaatgtagtgatctttatccactgttgggcttgggtcaaagaccttg

SEQ ID NO: 52146 - DNA, 205 bp, Homo sapiens
  misc_feature 23, 175: n = A,T,C or G
cttccttcagcagcgcaggcggnggtccctgaggcccgtggaaggagtcaaacttgcgggaattttgcagtttatctgcagggctgttgtttccagcaagacccaaggctagaaaaggaggaggaagaaactgacccgatcagtgccagaagtcattgtattcaaagaagaatangcgggggaaaaaaaaaaaaaaaaaaaaaaa

SEQ ID NO: 52147 - DNA, 490 bp, Homo sapiens
  misc_feature 3, 398, 485: n = A,T,C or G
acncacacaacaagacccagctggttgttagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatgcttacatagtttttggggaagccaagatcgaagatttatcccagcaagcacaactagcagctgctgagaaattcaaagttcaaggtgaagctgtctcaacgattcaagaaaacacacagactccaactgtacaagaggagagtgaagaggaagaggtcgatgaaacaggtgtagaagntaaggacatagaattggtcatgtcacaagcaaatgtgtcgagagcaaaggcagtccgagccctgaagaacaacagtaatgatattgnaaatg

SEQ ID NO: 52148 - DNA, 213 bp, Homo sapiens
  misc_feature 53: n = A,T,C or G
aggacctccccactggtgtagaagccacttaactggttcgtttgttcaacganttaaaagtcctacgtgatctgagttcagacccggagcaatccaggtcggtttctatctatttacgatttctcccagtacgaaaggacaagagaaatagagccaccttacaaataagcgctctcaacttaatttatgaataaaaaaaaaaaaaaaaaaaaa

SEQ ID NO: 52149 - DNA, 432 bp, Homo sapiens
tttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactggatgtgccaaagctttactactgtggaaagacaactgttttaataaaagatttacattccaaaaaaaaaaaaaaaaaaaa

SEQ ID NO: 52150 - DNA, 320 bp, Homo sapiens
ccacaagtttggtttctgtgggcattaaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactaaaaaaaaaaaaaaaaaaaaaaaaaaaaa

SEQ ID NO: 52151 - DNA, 445 bp, Homo sapiens
  misc_feature 13, 35: n = A,T,C or G
ctcttccggggangttgtctgcaggcacctcagantggtccagcgtttgacttaccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgcctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatggaaaagacgctgtaaaaaaaaaaaa

SEQ ID NO: 52152 - DNA, 310 bp, Homo sapiens
  misc_feature 19, 36, 84: n = A,T,C or G
cagacctagtgaccaagcntccctggtctttgagantgtctttcttcgttaaaggagatgggcccttttggaaggtaaaagganaaaactgaaatgaagttcttgtcatgattcacttcttctagaacttgcatgaccttttacttgtgttagctcttttgaatgttcttgaaattttagactttctttgtaaacaaatgatatgtccttatcattgtataaaagctgttatgtgcaacagtgtggagattccttgtctgatttaataaaatacttaaacaccaaaaaaaaaaaaaaaaaaaaaaaaaaa

SEQ ID NO: 52153 - DNA, 313 bp, Homo sapiens
  misc_feature 27: n = A,T,C or G
actggtttcccgttctgaaattgacantgaatgatattcaaagcatttctatcagaagatgtatggcattctcccttttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataat

SEQ ID NO: 52154 - DNA, 280 bp, Homo sapiens
  misc_feature 103, 125, 128, 153, 174, 176, 248, 272: n = A,T,C or G
tacggaaggacgttggggttgaggttagcatacgtatcaaggacagtaactaccatggctcccgaagttttgccaaaacctcggatgcgtggccttctggccnggcgtctgcgaaatcatatggntgnagcattcgtgctatccctgggggtngcagctttgtataagcttcgngnggctgatcaaagaaagaaggcatacgcagtatttctacagaaactacgatgtcatgaaagattttgaggganatgaggaaggctggtatctttcanagtgtaaa

SEQ ID NO: 52155 - DNA, 400 bp, Homo sapiens
  misc_feature 4: n = A,T,C or G
tacntttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaaagatgtccttgtttaagaaccc

SEQ ID NO: 52156 - DNA, 370 bp, Homo sapiens
acgtggactggatcaagaagagatggaggaggaggactgagcccagaattcactaggttcgaatccagagagcagtgtggaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccaaaaaaaaaaaaaaaaaaaa

SEQ ID NO: 52157 - DNA, 186 bp, Homo sapiens
  misc_feature 8: n = A,T,C or G
ggaagaangtcagggggacctgcaaaggcccaatgttggtgctggcaaaaaagaagtgagctggagattggatcacagccgaaggagtaaaggtgctgcaatgatgttagctgtggccactgtggatttttcgcaagaacattaataaactaaaaacttcatgtgaaaaaaaaaaaaaaaaaaaaa

SEQ ID NO: 52158 - DNA, 139 bp, Homo sapiens
gaagtactgacgttctgaagaaaaagcaaatgcattaagtactgtttgcccttaaaacttgtaagacctaaaccaaagtacttgtaaaaattaaaaccagcgattaaccagcaaaaaaaaaaaaaaaaaaaaaaaaaaa

SEQ ID NO: 52159 - DNA, 250 bp, Homo sapiens
  misc_feature 8, 17, 58, 60, 62, 150, 161, 167, 195: n = A,T,C or G
actttganaagctaaangtttcccatgagcgctcattcttcttttatgattcatacgntntnccttataaagtaagaactttgttttcctcctatcaaggcagctattatattaaatctttcacttaggctgagaaaaagcagatagtcncatatttaggnaaactntccaaatgaaataaatgttattctctgntaaagagctaatacagaaatgttcaagttattttactttctggtaatggcttcca

SEQ ID NO: 52160 - DNA, 327 bp, Homo sapiens
  misc_feature 206, 213: n = A,T,C or G
ctgccgaagatgactgccagaggacttggatctgagcttaaggacaggattccagttactgaactttcaccgagtgggccttttgaaagccatgatcttcttcggaaaggtttttcttgtgtagaaaaatgaacttttgcctagtcatccccttgacttatcacaaaaaaatttccagctcaaccaagataaaatgaatttttccncactganaaacattcagggtctatttgctccgctaaaattacagatggaattcagaggcagtgcaagcaggttcagcgtcttccatttctttcaagctcaaatctttcactggatgttttg

SEQ ID NO: 52161 - DNA, 311 bp, Homo sapiens
gtttgccttcccgaggtccttactttctggattgcctaagtcccatttcagtccaccactcttccagcttcgcagaaaatacctgaagttttggggtatttcctttcccccatttgatacttgtttttactaggtgcaactgtgaaggaaaaactttcttctttaaggattctcagtactggcgttttaccaatgatataaaagatgcagggtaccccaaaccaattttcaaaggattttggaggactaactggacaaatagtggcagcgctttcaacagctaaatataagaactggcctgaatctgtgta

SEQ ID NO: 52162 - DNA, 400 bp, Homo sapiens
  misc_feature 391: n = A,T,C or G
tgaatgctcaatgcattcgaaagaggacatagtaattctaaacattcacgcacctagtaacagagcttcaaaaatctacgaaagagaaactgatagatctgcaaagagaaatagaaaaatctgcaatcatagttggataatttaatacatttttctcaacaagcaatagaacaagtagacagaaaatcagtaaggatatagaaaatttagacaacgccatccaccaacttgccctaattgacatttatagaaaacatcattcaataataacagaatacacattttcaaaggtacacaaaataattaccaacttatactgtattcgaagtcatcaaataagtcttaatggatttaaaattttcaagtaaccttactctcaatagtgggtggntcatccaga

SEQ ID NO: 52163 - DNA, 430 bp, Homo sapiens
  misc_feature 41, 394, 401, 403, 404, 410: n = A,T,C or G
gttctggataccaaaaatgcacgcaagcccttctctctccntgggaagctaagttacaaaaataggtgcttggtgtacaaaactttttactattcaaaaggctttgcacatttctctatgagtgggtttacttggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatggaaaaaaaaaaaaaaanaaggggnanntttttnaaaaaaaaaaaaaaaaaaaa

SEQ ID NO: 52164 - DNA, 350 bp, Homo sapiens
  misc_feature 151, 153: n = A,T,C or G
ctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggntnattgggatgatgacaatgtagaggatgacttctctaatcagttacgagctgaactagagaaacatggttataagatggagacttcatagcatccagaagaagtgttgaagtaaccctaaacttgacctgcttaatacattctagggcagagaacccaggatgggacactaaaaaaatgtgtttatttcattatctgc

SEQ ID NO: 52165 - DNA, 260 bp, Homo sapiens
  misc_feature 15, 97, 132: n = A,T,C or G
tccaatgggcgaaantatacgacatcttcaagccagtgcgcacagcactttgatatgcctcatgatattgttgcatctgaagatgggactgtgtacnttggagatgctcataccaacaccgtgttggaagtncaccttgactgagaatttggaacatcgatcagttaaaaaggctggcattgaggtccaggaaatcaaagaagccgagacagttgttgaaaccaaaatggagaacaaacccacctcctcagaattgcaga

SEQ ID NO: 52166 - DNA, 285 bp, Homo sapiens
  misc_feature 2, 24, 26: n = A,T,C or G
anagaaagttctattggacagtgntnttctagatcctcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcataaaaaaaaaaaaaaaaaaaaaaaaaa

SEQ ID NO: 52167 - DNA, 470 bp, Homo sapiens
  misc_feature 66, 340: n = A,T,C or G
gtgcaaatgagggaaccttggatcttgctgccaaggggttaaaattgggaacctaagttgctactnaaatcctagttcaaaacctaataactgttgtcgttgttgctatctgatttcattagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgnggaagaagactgcttatctcagagtgaagatactgcggctgaaaagcactagtttgatataaaattaaaaatgaccaaaaccctccaactttgaagctaaagaaggtaaacctttccattattgcattac

SEQ ID NO: 52168 - DNA, 360 bp, Homo sapiens
tcttcaaaaaatggtgccagctttgctgtttaatggtacaactgaagaggaaggagccttcccattttccttaaaagaggcaaaggagtcatacccacatagcactactgccagtcactcttgccttcacagggtcacctctcctcacagaaagcagactggacaaatatcagggcccacctccctccaacatggaaacaagtccccctaagaaagagctgagacctagtgtgctaatacctgttgtaatttttgtggagataaaggtgcaggagaataaactcctttataaagaagtgtctttcaggtgttctgaaaccctgccttgttacttacctttattaaaagaaccgaaataat

SEQ ID NO: 52169 - DNA, 285 bp, Homo sapiens
  misc_feature 52: n = A,T,C or G
cactgttttaaagaaacaaaaaacccaaaccttgccctgatttgaaagtgcntgtagagtttttgattatcacagaaatttgttgtgtaccgtcttttttattataagttcagtgctttgaaaattagaatccaaggtgggtatggttggctcacgcctgtaatcccagcactttaggagaccaaggtgggaggatggcttgagcccaagatttcaagaccagcctgggcaacattatgagaccctatctctcatttttttttaataaaaaaaaaaaaaaaaaaa

SEQ ID NO: 52170 - DNA, 280 bp, Homo sapiens
  misc_feature 141, 261, 276: n = A,T,C or G
acatagaaacacaaagtgagtacatgttattggaaaaaatggtgccaatagacttgcttgatgcagcattgccacaatattcaattggtaaaagcacaatattgtgaagtgtgataaagcaatgtgttagtctgttttgcntggctataaaggaatacgtgtgactggctaatttacaaagaaaagagatttatttggctcattgtttagcggggtgtctgggcatggcagcagcatctgcttggcttttgtgaggcttcnagaagcttttattcntggc

SEQ ID NO: 52171 - DNA, 447 bp, Homo sapiens
ctctgcacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttgggaaaaaaaaaaaaaaaaaaa

SEQ ID NO: 52172 - DNA, 550 bp, Homo sapiens
acatcacgcacgttctctgccgggctgtcctttttagtcaatttggctcaagattagactccagaagcattttattttgccctctaaggtcccggcccacacctgtatgactgtctgtccacgctgctgtttgcagtttctttttgttgttaacaagtaggctctgctttgccatccctgccgtctggtcaccttttacttagaaattggagagtggttttctttccctctccctgtatcacaggtcaagttgaagggtacggtcacctgcagggaacaggaccaagtgtattcattgagcactttgctgttttacatgacctcgccataaaggagtgtctctacgagaaaggaaaaacctgtttcataacgcagtgcagagctttgttttctctcgtcagggtgacagccctttggttcctgccagtgggtatgcgacaggaaggtggggaaactggatcatgaaaattccacggctggcaattgctcattctttagccttctagccagaggataggggcctgggtcccagggtggctcagtacagtat

SEQ ID NO: 52173 - DNA, 287 bp, Homo sapiens
  misc_feature 4, 5, 19, 20, 40, 119, 127, 134, 135, 137, 138, 142, 143,144, 152, 154, 168, 170, 172, 173, 175, 176, 180, 191, 208,210, 212, 219, 225, 226, 227, 230, 236, 246, 247, 248, 250,252, 264, 265, 267, 269, 270, 275, 280, 282, 283, 285: n = A,T,C or G
  misc_feature 286: n = A,T,C or G
tttnncccgggtattcggnnttatggccggggggccaagnatcatgccactgccctccagccttggtgacagagtaagacactgtctggaaaaaaaaaaaaaaccccccccccccccanttttttcnggggganncnnggtnnnctaaaatntncccttttttttttnangnntnnaaantttggcggggntttttcccccattttancngnggttggnttgggnnnggnaaattntggggggggnnngncntttttgggcctnngncnnaaggnagggncnntnnt

SEQ ID NO: 52174 - DNA, 460 bp, Homo sapiens
  misc_feature 92, 215, 369, 400: n = A,T,C or G
tgggcatatcagtatttaacattggatgttttatgttttatatttataatggggaaaatgcaagcataacatttaatatttgtccacatggntttacaaaagtaaatcttaaattactaagcttttcccatatgttctcgtactttctcaaatccctataaagaattacttgttatctattaaaaatctcctttacccatctgtattatgggggngcgccagacaaatattatgtgatgtagcccagaaaatccacaccttttgtcctttttatgttttaatttgaataatcatgtgcttagtcccttggattactgccacatcagtttaacacgatatcagcacattccccttgtcatcatcaagggngttggctcagatttattcttaatttggatgnttaaaagcatgtactaccttgttacagttggttttagtgtagtggattattgacatgaca

SEQ ID NO: 52175 - DNA, 420 bp, Homo sapiens
acttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaaaaaaaaaaaaaa

SEQ ID NO: 52176 - DNA, 287 bp, Homo sapiens
  misc_feature 14: n = A,T,C or G
gcagcagctcctanaaggcagcccctgctggaagcatgcgacaccctgcgccggggccctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaatcaaaaaaaaaaaa

SEQ ID NO: 52177 - DNA, 160 bp, Homo sapiens
  misc_feature 57, 130: n = A,T,C or G
tggaaacttggctgcaaccttcaagcacaaaataaaaagtaaacatttacatgaaanatggtggatatggaaggtggagaagagaggagataacagctttatctttcaaaatagagaattgagagatggnaccaaaagctgatgaagtgaaaaaaaaaaa

SEQ ID NO: 52178 - DNA, 121 bp, Homo sapiens
  misc_feature 39, 55, 67, 78: n = A,T,C or G
gccccagaaaggggaaaggaacacgcggggagatgattnctagcaggcaggaagncctgggcggggncaccatgagcnggggggagctgtactagtgccattggaataataaatttgataa

SEQ ID NO: 52179 - DNA, 258 bp, Homo sapiens
atggttttttcctggagttgacactggcagaagctctcaagttattgatcgtaagagctctctcctcacagagctcagcaacagcctcaccaaggactccatgaatatcaaagcccatatccacatgttgctaggaggggcttagagaactacaaggcctgcagaatttcccagagaagcctcaccattgacttcttccccccatcctcagacattaaagagcctgaatgcctttgaaaaaaaaaaaaaaaaaaaaaa

SEQ ID NO: 52180 - DNA, 136 bp, Homo sapiens
aagtatatgggaccttaagctcaccttctttacttgtatcaaatgatgactggtatactggtctcccatccctttgcttgtggcaggagatggcttaaataaataacttaaatttagaaaaaaaaaaaaaaaaaaa

SEQ ID NO: 52181 - DNA, 342 bp, Homo sapiens
  misc_feature 23, 318: n = A,T,C or G
cagccggaaggccaaagtcaagnagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgnctaaaaaaaaaaaaaaaaaaaaaa

SEQ ID NO: 52182 - DNA, 580 bp, Homo sapiens
  misc_feature 512: n = A,T,C or G
agttgccctttggggaaacccagtaatatgtcagatctttgtcaggtcgctgtgggtctttgtcaaggtcccaactctgtcacagggattttaggcaactagaaccacaggtgtcacttccaaaattgatagcttgttatactgcaaccagagtcaattttagattggagaagagaaagaaaaagataggaaatgattgaagctgtgggcaccaagaaagggcagtgctggaaagagaatgaatgacatagacacccaataacagggagcgttggtcatttttgcatggaccaaaacaaaattgaagaagtactgctgatcaaaggccaatacaatgcacacacatcattctggttaggttgtctcctgagaaaaatatttctcagcagcagtatgatttattttgaacaatatctgattgaacagcattctagtaatgtagaaaatttatagacatctactaaattttattctagcagataatccacattaaaagagacaaaagtccatgntttacctagaacctctctgtggctccttttctccaccagaaagacaataatttcatatctggcagaag

SEQ ID NO: 52183 - DNA, 315 bp, Homo sapiens
  misc_feature 28, 83: n = A,T,C or G
tgttgaaagtaattcattctcccatagnataaatgaaacttgaaatgtgtaaactttgaagaacataaaaacttcatggtggnttcttattaagacagtggactagacatctaataaaacttctttccaaaatcccgggtgataatttgagtcctcagagaagcagatgacatgacaaagttagatgtgcaagaatttattagaggaaacataaatggaggataaacgggagatggagcaagcgtaggtcgagagagccttcagactgcagtgtgggtctgacacctgtgaaaaaaaaaaaaaaaaaaaaaaaaa

SEQ ID NO: 52184 - DNA, 212 bp, Homo sapiens
aatcttagttcaactttaaatttgcccacagaaaccctctaaatccccttgtaaatttaactggtagtccaaagaggaacagctctttggacactaggaaaaaaccttgtagagagagtaaaaaatttaacacccatagtaggcctaaaagcagccaccaattaagaaagcgttcaagctcaacacccactaccaaaaaaaaaaaaaaaaaa

SEQ ID NO: 52185 - DNA, 180 bp, Homo sapiens
  misc_feature 36, 77: n = A,T,C or G
aatatttaggacatgaagtaagtaagaactttagtngatttattgtgaagactaaagatgtttcagataatagaggnagtaattatcaaagcaaagtttttcgaggtattaagggttggaatgaaaaatacaggtgtatctctcatacaggtgattaaaaaaaaaaaaaaaaaaaaaaaa

SEQ ID NO: 52186 - DNA, 193 bp, Homo sapiens
  misc_feature 10: n = A,T,C or G
aacccaaagnagagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaaaaaaaaaaaaaaaaaaaaaa

SEQ ID NO: 52187 - DNA, 400 bp, Homo sapiens
  misc_feature 135: n = A,T,C or G
tctctggtttcctttatatgccttaaaaataacggactggggtgagggattgaactgggagggcagagacctgggctgtggatggaaatgtgagccgttaagaaagagtgcattctggcaagccaggctactgcnctgagcttcagcttctgtaaaactgaatggcgctgtgccagatcatatgggagcaggagggacacatacatgatcactttcagtttcacgtcaaatgtggcacagaaacttctccattcctcacttttactttcaatttccctgcccaacctcagttcttcgtgggattttagactttgaaagtgactacagagggtgaaatccaactccccagtggctggaatctgacatccggtttcccaaactccctgtggggaatgaccag

SEQ ID NO: 52188 - DNA, 155 bp, Homo sapiens
gattaatattattaatataataatgatgatgatgatgatgaaaactaaggatttttcaagagatctttctttccaaaacatttctggacagtacctgattgtattttttttttaaataaaagcacaagtacttttaaaaaaaaaaaaaaaaaaaa

SEQ ID NO: 52189 - DNA, 289 bp, Homo sapiens
ataacggaaaaacgatttctaaagcacagcaggtatttttgtacagggaagtttaaatgtgtttgtgtatggaaaactctccactctcctcccctagatgccatgcttccttttgcctgttacggttgccatgttttttgaataacaaattatataacattttatcctctctcaccacaaggacaaagtatggatgtggcagagtcctgatgaaagatgtatccaaacaagataacttatatgtataaaattaaagcatataatatacaaaaaaaaaaaaaaaaaaaaa

SEQ ID NO: 52190 - DNA, 500 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatattgatatgcttatacacttacactttatgcaca

SEQ ID NO: 52191 - DNA, 500 bp, Homo sapiens
aagcatggaagcaaacttgttccgaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcagggagaagctacccaccatgcggtggattctgcggtcaatgttggcgtaactgcctacaatattaacaacattggtatcaaagcaatgggtgaagaaaactgcaacacaaacaggacacactctccttgaggactatcagatagttgataattctcagagggaaaatcaagaaggagcagcaaatgtcaacgtgagagggggagaaaggatgagcagacgaaaggaagtaaaggaggcaaagaagaaagataaatgaatgaagtgctgggaatcacttataccaaagccttatg

SEQ ID NO: 52192 - DNA, 172 bp, Homo sapiens
  misc_feature 22, 143: n = A,T,C or G
ggcaaaagtagaaaaataaggntgatcagagcattgcgcaatacagtttcattaactccttcccccgctcccccaaaaatttgaattttttttcaacactcttacacctgttatggaaaatgtcaacctttgtaagaaaaccnaaaacaaaaaaaaaaaaaaaaaaaaaaaa

SEQ ID NO: 52193 - DNA, 280 bp, Homo sapiens
  misc_feature 211, 249: n = A,T,C or G
acccaaggggccttcgaggtgccttaggccgcttgccttgctctcagaatcgctgccgccatggctagtcagtctcaggggattcagcagctgctgtaggccgagaagcgggcagccgagaaaggtgtccgaggcccgcaaaagaaagaaccggaggctgaagcaggccaaagaaagaagctcaggctgaaattgaacagtaccgcctgcngagggagaaaagaattcaaggccaaggaagctgcggcnttgggatcccggggcagtttccagccctgaa

SEQ ID NO: 52194 - DNA, 341 bp, Homo sapiens
  misc_feature 212: n = A,T,C or G
accgtaccttaaaatattaactgctttttagaaaccaataaaaagtcttgtgaaatgttaaatgataaagttgatcattacatttgttaccaaccttgttagtcaatgtgacgtgacttttttcatgatgatgttttcacttgaaataaaatgagctttagggtttggcaaatacctttaaaatgtaatgctgaaattcaactctaaccagntctgaatctatcgtcatacatacacatcatctataacaatttcttttactgaaatgattgcttaaaagtatgaatttcattaaatttcctattgtaaaatatttatctgctgcatttcacagtaaaaaa

SEQ ID NO: 52195 - DNA, 388 bp, Homo sapiens
ggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgca

SEQ ID NO: 52196 - DNA, 497 bp, Homo sapiens
  misc_feature 211, 364: n = A,T,C or G
attgccgataatttttagcttagggcctggtggctaggtcggttctctcctttccagtcggagacctctgccgcaaacatgctccgccagatcatcggccaggccaagaagcatccgagcttgatccccctctttgtatttattggaactggagctactggagcaacactgtatctcttgcgtctggcattgttcaatccagatgtttggngggacagaaataacccagagccctggaacaaactgggtcccaatgatcaatacaagttctactcagtgaatgtggattacagcaagctgaagaaggaaccgtccagatttctaaatgaaatgtttcactataacgctgctttagaatgaaggncttccagaagccacatccgcacaattttccacttaaccaggaaatatttctcctctaaatgcatgaaatcatgttggagacctctattgtaatctctattggagattacaatgattaaatcaataaatacctt

SEQ ID NO: 52197 - DNA, 403 bp, Homo sapiens
  misc_feature 8: n = A,T,C or G
ataaagcnaaatttccgtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattccaaaaaaa

SEQ ID NO: 52198 - DNA, 480 bp, Homo sapiens
  misc_feature 19: n = A,T,C or G
atctgtatattcttaatantctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtatttaatgtgccaaggagccgttttctgcctgtcaaaaccacatcagatctcttgctgggggatgtcaaacctctatagtcttaatgcaggatctctgacaatgag

SEQ ID NO: 52199 - DNA, 500 bp, Homo sapiens
cacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctatagatgctaggatatatataaattattttataaattcttgttttaaatgtcagtgtttctatgattgtaaactattaaattcttttcctattaaagtacagacctaatctaagtattattaagttgatagccctctagtcagttatattgctattgtaaattcttggttggtgagtaaaaatggttaaatactatatgtatctcatgac

SEQ ID NO: 52200 - DNA, 431 bp, Homo sapiens
gaaagttgacatctgacgacgtgaaggaagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaa

SEQ ID NO: 52201 - DNA, 400 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaag

SEQ ID NO: 52202 - DNA, 420 bp, Homo sapiens
  misc_feature 23, 65: n = A,T,C or G
gagtcgcgagcgaacgaccaagnaggtgttcgactgctagagccgagcgaagcgatgcctaaatnaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgat

SEQ ID NO: 52203 - DNA, 500 bp, Homo sapiens
  misc_feature 18, 212, 297, 379, 498: n = A,T,C or G
ctctatacaggacttagnaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttctttnatacctttcctttttgggggagttgttatgccaagatttttggtatttatgtaaaaggattattactaattctatttctctatgnttattctagttaaggaaatgttgagggcaagccaccaaattacctaggctgaggttagagagattggccagcaaaaaactgngggaagatgaacctttgtcattatgatttcattatcacatgattataggaaggctggcttagggcaaaaaacatacttacatttcagacatatccaaagggaatactcacatttttgtnaa

SEQ ID NO: 52204 - DNA, 500 bp, Homo sapiens
  misc_feature 272, 478: n = A,T,C or G
cattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggnctttctatctcttgtactacactgaattcacccccactgaaaaagatgagtatgcctgccgtgtgaaccatgtgactttgtcacagcccaagatagttaagtgggatcgagacatgtaagcagcatcatgggaggtttgaagaatgcccgcatttggattggatgaaattccaaaattctgcttgcttgcttttttaatattgganatgccttatacacttacacttt

SEQ ID NO: 52205 - DNA, 496 bp, Homo sapiens
  misc_feature 388: n = A,T,C or G
taaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatgggatgttactctcttgcaccaaattatcttgatacattcaaatttgtctggttaaaaaataggtggtagatattgaggccaagaatattgcaaaatacatgaagcttcatgcacttaaagaagatttttagaataagaatttgcatacttacctagngaaacttttctagaattatttttcactctaaggcatggatggttctctttggattatttgcatggtatggttaataagctactagcaaaataaaacatagcaaatggc

SEQ ID NO: 52206 - DNA, 410 bp, Homo sapiens
atctacaaaatttttctttcctcaagaaaagagttccttttgccttattccttatgccttccccactggtattgagggttttgataataaattggtaggaaaaaaaagtacctcctagaaggaagccttccccaccatttccaggtgccaactactaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatggaatttttactgatcacattttggaaatgcctaaaaagactttattgttctaattatccagatgtacctttgt

SEQ ID NO: 52207 - DNA, 279 bp, Homo sapiens
  misc_feature 212, 213, 243, 258: n = A,T,C or G
ggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttnnatactgtatgtgccaaagctttactactgnggaaagacaactgtnttaataaaagatttacattcc

SEQ ID NO: 52208 - DNA, 500 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcattggagggttttgaagatgccgcatttggattggatgaattccaaattctgcttgcttgctttttaatattggatatgcttatacacttacactttatg

SEQ ID NO: 52209 - DNA, 370 bp, Homo sapiens
  misc_feature 145, 150, 215, 225, 307, 340: n = A,T,C or G
caacatagagaaggacattgcggctcatatcaaggaagggaatttgacaagaagtacaatcccacctgggcattgcatcgtggggaggaacttcggtagttatgtgacacatgaaaccaaacacttcatctacttctacctgggncaagnggccattcttctgttcaaatctgggtaaaagcatggactgtgccacacacccagtgatccatccnaaaacaaggnctgcagcctaaattccaaataccagagactgaaattttcagccttgctaagggaacatctcgatgtttgaacctcttgttgngttttgtacagggcattctctgtactagtttgngcggggggtataaaacaattagcagaatag

SEQ ID NO: 52210 - DNA, 480 bp, Homo sapiens
aacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgtgtaaaggaacttaagtatttggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgaggatgccgttattcctattact

SEQ ID NO: 52211 - DNA, 420 bp, Homo sapiens
  misc_feature 8, 12, 309, 361: n = A,T,C or G
ttttttcnttantattatgtgtgttgcggggaggaggattgagtttatttgactaggaagggataaaaatacattcctgactggagactgtactcagagattggtcttggtgtatacccctgatttctaagatgaatgttactgagaattgacaattttttttgttgattgttgtgtttccactaagttattcatctcattttggcctgctattagctagttgacccaaatcacagtgctggatgacttgaaaagctctgatttaatttttgcctagtatatagttatagtagcatataggttaaaggntaaaagttacagctttgatcctataatggtcagttagtttcccacgaaaggntaaaatgctatagactaaaactaacagctgtcttaagggatttgccactccttataagg

SEQ ID NO: 52212 - DNA, 327 bp, Homo sapiens
  misc_feature 212: n = A,T,C or G
aattgttagctgttttgaaattctatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgtnctggactgcaaatctgcacacacaacgaacagttgcatttcagagagttctctcaatttgaagttatttttttttaataaagaatttttgtttcctaaaaaaaaaaaaaaaaaaa

SEQ ID NO: 52213 - DNA, 450 bp, Homo sapiens
  misc_feature 325, 339: n = A,T,C or G
aatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtncttccatgcaaggncccactctaggtgatagacagggaccccttctactgaacctttgaggaaaggaggaaggaagaaatgcgtttagatcttggatgcagacctttcaaagggttaaatgtaac

SEQ ID NO: 52214 - DNA, 490 bp, Homo sapiens
atatagcaaaataaactcaaggtgggttaaagacttaaatgtaaagcctaaaactatgaaaatcctaaaagaaaacttaggaaataccactctggacataggttgcggcaaagatttcacgatccagatgtcaaaagcaattaaaacaaaaacaaaaattgacaagtgggacctaactaaagagcttctgcagagcaaaagaaactatcaacagagtaaatagacaatctgcagaatgagaagaaatgtttgtgaactgcagctaacatagctctaatatctggagtctataagatactcatacaaattaacacgcaaaaaacaaacaaccccattaagaagtgggcaaaggacatgaacagaaaattttcaaaataaaatgtaaatcagccaataggcatattgaaaaaatgctcaacatcactaatcattagagaaacgcaaatcaaaaccacaatgagataccatctcacactagtcagaaaggcta

SEQ ID NO: 52215 - DNA, 263 bp, Homo sapiens
cagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcataaaaaaaaaaaaaaaaa

SEQ ID NO: 52216 - DNA, 320 bp, Homo sapiens
ctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagcctaaacctgtggcctctgccacgtgctccctgccagcttcccccctgaggttgtgtatcatattatctgtgttagcatgtaagtattttcagctactctctattgttataaaatgtagtactaaaaaaaaaaaaaaaaaaa

SEQ ID NO: 52217 - DNA, 353 bp, Homo sapiens
tggttgcatggaaatcagccaagttttataattcttaaatcttaatgttcctcaaagcttggattaaatacctatggatgttactctcttgcccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcgcaaaaaaaaaaaa

SEQ ID NO: 52218 - DNA, 370 bp, Homo sapiens
ccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgaggggtgtgagaaactcacagaatacaaatttgc

SEQ ID NO: 52219 - DNA, 470 bp, Homo sapiens
  misc_feature 21, 232, 309: n = A,T,C or G
aacaagcacaaaatctacttntggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagntgagaaagaatttgagcctctgctgaattggatgaaagataaagcccttaaggacaagattgaaaaggctgtggtgnctcagcgcctgacagaatctccgtgtgctttggtggccaaccagtacggatggtctggcaacatggagagaatcatgaaagcacaagcgtaccaaacgggcaaggacatctctacaaattactatgcgagtcagaagaaaacatttgaaattaatcccaga

SEQ ID NO: 52220 - DNA, 460 bp, Homo sapiens
  misc_feature 43, 340: n = A,T,C or G
caaagttgagctgaagaacggtgccacttacgaagccaaaatnaaggatgtggatgagaaagcagacatcgcactcatcaaaattgaccaccagggcaagctgcctgtcctgctgcttggccgctcctcagagctgcggccgggagagttcgtgatcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggnaattaacactttgaaaagtgacagctggaatctcctttgcaatcccatctgataagattaaaaaagttcctcacggagtcccatgaccgacaggccaaaggaaaagccatcaccaagaag

SEQ ID NO: 52221 - DNA, 284 bp, Homo sapiens
  misc_feature 200, 202, 204, 212, 239, 259: n = A,T,C or G
tagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatntntntggccggncccatatgtataaacttttcagcagcntttttaataataaaatatcncagtattttctaaaaaaaaaaaaaa

SEQ ID NO: 52222 - DNA, 238 bp, Homo sapiens
tggtttgtaactttccttgtacttaattgggtaaaagtcttttccacaaaccaccctctattttgtgaactttgttaagtcatcttttatttggtaaattatgaactggtgtaaatttgtacagttcatgtatattgattgtggcaaagttgtacagatttctatattttggatgagaaatttttcttctctctataataaatcgtttcttatcttggcattttaaaaaaaaaaaaaa

SEQ ID NO: 52223 - DNA, 310 bp, Homo sapiens
ctttttacctcgttgcactgttgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttcaaaaaaaaaaaaaaaaaaaaaaaaaa

SEQ ID NO: 52224 - DNA, 223 bp, Homo sapiens
  misc_feature 31, 107: n = A,T,C or G
acctcaacacagtgccttttaattggtgacnaacctcaaaacaccttgacaaaccgttaaaaacagtatcagaaaccctgtgtacattccctgtgccttctttaagnttgctaagttctgctctcacttcttactttcaaaggacactttttaaagaattgttaatgcttttttataatacaagtcatagccctgttggcaaaaaaaaaaaaaaaaaaaaaaa

SEQ ID NO: 52225 - DNA, 410 bp, Homo sapiens
  misc_feature 11, 34, 365: n = A,T,C or G
aggaaaccaanactcacagcctaaccccaccccntaccctttgtgcagtgattacctttttaaagtcttctttcatgtaagtagcaaacagggctttactactcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttggnaggttgttaggttgccctgctacctagtttggtaggggcattttg

SEQ ID NO: 52226 - DNA, 510 bp, Homo sapiens
gattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagac

SEQ ID NO: 52227 - DNA, 280 bp, Homo sapiens
  misc_feature 128, 254: n = A,T,C or G
gacattgagaaatgcctcacagctatcgtgaagtgcgccacaagcaaaccagctttctttgcagagaagcttcatcaagccatgaaaggtgttggaactcgccataaggcattgatcaggattatggnttcccgttctgaaagggacatgaatgatatcaaagcattctatcagaagatgtatggatctccctttgccaagccatcctggatgaaaccaaaggagattatgagaaaatcctgggggctctttgnggaggaaactaaacattcccttgatg

SEQ ID NO: 52228 - DNA, 354 bp, Homo sapiens
gtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtatttatgtagcatgcaatgtgttattgtaagtgcttaataaaaataaaacaaaaaaaaaaaaaaaaaaaa

SEQ ID NO: 52229 - DNA, 440 bp, Homo sapiens
  misc_feature 211, 361: n = A,T,C or G
ccaatttaatacctaagtttatctaactttacaataaagctttttttcccctataaatacttttctacctcctttgaaaaattgaaataccttaattttggtttatgtaataagttgtctacgttccttcctcctctgaaaattaatgtgggttgtcagaattacagactttttaatgcctaagattttaagaaataaacctgtaggtgtnggcaggacttatttcatttagattttaatttagttttgatgtgtagaaatgatttttatctgtaaggctctctctccaccaaaataagtgaattgtttgggagtaaactagttggtaagttgggccttgctgatagatttatacactggngtgtaagccctatactgctgctgtcactaatgtttttgatagtttacttaggcatgactgctgttaataaaagtttgct

SEQ ID NO: 52230 - DNA, 400 bp, Homo sapiens
  misc_feature 30, 31, 105, 115, 154, 244, 257, 259, 278, 307: n = A,T,C or G
aacatttatagcaattttttttttcccggnnaagtttaggttgcaagttttgggtttcttgtttgtttttgttttgcttcctgctttaattctttaattttcagncattactggnattgaaaaataaaatatctttaaaacatctcctcttcanaaataggtccctcttcattgcccatcaccatcttccactctcctattattttgccactactcagtaaaggaaggtaggaagagacaaacncctaagtgcaggngnggggagggatttcacaagnggttattaacggccagttcagcaagaagngttgagtgtgtacaaaggggagggctggaagtgttaactccagacccgttggctgcttgagttgtttcttatattctaaagcagcagtcccta

SEQ ID NO: 52231 - DNA, 450 bp, Homo sapiens
gagccccacatgccagatgtgtggagaaaagtttcttaagcattcagacgaagccctgaaaatcctagggggtgttggactcttctttagctttacagaggtaacattctccagttccctcacacacatcctttttgagactgagaattaattgatacttatctctctccctttgttcctacagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttaggggggagccagactataaggaat

SEQ ID NO: 52232 - DNA, 341 bp, Homo sapiens
  misc_feature 10: n = A,T,C or G
gttcaagaanatctcctgcctcggcctcaccggtagctgagattacgggtgcccaccaccatgcctggctatttttttgtatttttagtagagacggggttttactatgttggccaggctggtctcgacctcctgacctcgtgatccacccgccttcatcctcccaaagtgctgggattacaggcgtgagccaccgcgtctttatgagaaccgctgcctcttatctgacgattgcagtgatgtacatcgcgcggcaccagctcttcccattggctttcaccgtagagaagaatttaaaaaataattttctcggttttttttagtgatggtacatgataagt

SEQ ID NO: 52233 - DNA, 420 bp, Homo sapiens
  misc_feature 340, 361: n = A,T,C or G
ggagtcagaaagcataggctatatttttaattatgtcagaagttaatactagaactattaaaaagccactttcctctcctgagattgtctttctttatttgaaaactggagttggactttttttgttgaatgattctaagaaatgttttagattgtcaagaaatcagatacaaattcatccccctgtggaggagccctatctgtgcctcttctgtaataccagtagccatggtatgtattgcagtatgatgctaataagtacagtcatttgagtacttaccatattcttcttctagtttatacgctctctaaaggaagaacacttgttcatctttctggntttttagcctagtacaatggntttgtacccatcagataattcaacaaatacgtactaaatgataaacaataacagattct

SEQ ID NO: 52234 - DNA, 480 bp, Homo sapiens
  misc_feature 215: n = A,T,C or G
ggagtatcgatctaagtaggcgactgtcgaaccggaaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagttngatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgtta

SEQ ID NO: 52235 - DNA, 180 bp, Homo sapiens
gcagtataaagggagcagggaaggcgggagacagcgcagttttgaatcgcggtgcgacgaaggagtaggtggtgggatctcaccgtgggtcccgattagccttttctctgccttgcttgcttgagcttcagcggaattcgaaatggctggcggtaaggctggaaaggactccgcaaagcc

SEQ ID NO: 52236 - DNA, 351 bp, Homo sapiens
gttggggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgcgaaggaacaacacctaaacccaagagggcagctgttgcagcatccagttcatcttaagaatgtcaacgattagtcatgcaataaatgttctggttttaaaaaataaaaaaaaaaaaaa

SEQ ID NO: 52237 - DNA, 249 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaaaaaaaaaaaaaaaaaa

SEQ ID NO: 52238 - DNA, 316 bp, Homo sapiens
  misc_feature 13: n = A,T,C or G
attaccagcaagnactaaaaagaaatccctatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttggaaaacctaaaaaaaaaaaaaaaaaaaaaaaa

SEQ ID NO: 52239 - DNA, 130 bp, Homo sapiens
gtctcaggaagctgtagaaggagtgtttgtcaatttcttgtcactggtttgctgacttactgaggattaattgttgccttacaatgttactgaaataaactgtttaatataaaaaaaaaaaaaaaaaaaa

SEQ ID NO: 52240 - DNA, 440 bp, Homo sapiens
  misc_feature 33: n = A,T,C or G
gaagctctgtttggtgctttggatccatttccntcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaat

SEQ ID NO: 52241 - DNA, 340 bp, Homo sapiens
  misc_feature 40, 95: n = A,T,C or G
ttttaagtgtgtgctaaggcacatggaagaccgattttantttgcacaaggtacttgagaatttttttcaagaaacagctgtcaaatctcaaggngaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctgggttttggtatatatccattccagcttaatgcctctaattttaatgccaacaaaattgggttgtaatcaaattttaaaataataaataaatt

SEQ ID NO: 52242 - DNA, 138 bp, Homo sapiens
ggagatgaatgatgaatgaagctgagtcagctacgggcaagcgggcagcttgaaagatgatgaggatgacgatgtcgatacccaagaagcagaagaccgacgaggatgactagacaacaaaaaaaaaaaaaaaaaaaa

SEQ ID NO: 52243 - DNA, 280 bp, Homo sapiens
  misc_feature 201, 225: n = A,T,C or G
cagcaggcgatgcgcgaaggcgggacttggaggttctggatgttcctgtggataacctcaaggaacacgggacctgggacatgactgcccccagcattccttctggcggcagacagagtttgtcaagttcgccaacatcctgctttcatgagaacagtttgctgtttgctcacagagcctccagtggtatactgagttggncacgaccctcattccttcggcctncaacatctccccttttgtttttgcattaattgaataaagggaatttcaggctgaa

SEQ ID NO: 52244 - DNA, 205 bp, Homo sapiens
  misc_feature 7, 89: n = A,T,C or G
attcggnaaaaacctgtacttgaaaacacttagtactgcagttgataagaggaatttggtataattactggtgggtgattattttttantactgtatgtgccaaagctttactactgtggaaagacaactgttttaataaaagatttacattccaaaaaaaaaaaaaaaaaaaaaaaaaaaaaaaaaaaaaaaaaaaaaaaaaaa

SEQ ID NO: 52245 - DNA, 440 bp, Homo sapiens
  misc_feature 83, 417, 429: n = A,T,C or G
gctttccaacttggacgctgcagaatggctcccgcaaacaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttgccactttcaaaaatctacagacagtcaatgtggatgagaactaatcgctgatcgtcagnatcaaataaagntataaaattgc

SEQ ID NO: 52246 - DNA, 410 bp, Homo sapiens
ggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaat

SEQ ID NO: 52247 - DNA, 400 bp, Homo sapiens
  misc_feature 27: n = A,T,C or G
tgggaaggaaatctatttgtaaaagangaaggctgtatctactttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttattta

SEQ ID NO: 52248 - DNA, 145 bp, Homo sapiens
  misc_feature 104: n = A,T,C or G
cctgtcagttccaatgaggtggggatggagaagacaattgttgcttatgaaagaaagctttagctgtctctgttttgtaagctttaagcgcaacatttcttggntccaataaagcattttacaagaaaaaaaaaaaaaaaaaaaa

SEQ ID NO: 52249 - DNA, 170 bp, Homo sapiens
gcaatcatcaaataattctgaacacaagatttaatatttttttttcctgaatgagaaacatgagggaaattgtggagttagcctcctgtgggaaaggaattgaagaaaatataacaccttacaccctttttcatcttgacattaaaagttctggctactttgggaatcca

SEQ ID NO: 52250 - DNA, 400 bp, Homo sapiens
aagactgcttatggttttaaaattgcaatgacttaaataatgaggttgttaattagagtcagagcctgttcacatattgtgatcaggtagcaatgacatgtaccacttaaattattttatcgtcgatttggtagttcgattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaacctctaagttttactcctaacatacatatgtttgggggaagtattctattctatacttgccaatgtggagaacaaaat

SEQ ID NO: 52251 - DNA, 270 bp, Homo sapiens
atttgaactactatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaat

SEQ ID NO: 52252 - DNA, 430 bp, Homo sapiens
  misc_feature 297, 322, 383: n = A,T,C or G
actcgaaaccttgacttgagctttcaatcagatagccagacttgcctttctggtctccctgtctcttctttctaacttctctactttagacaacaataagatcagcaacatccctgatgagtatttcaagcgttttaatgcattgcagtatcttgcgtttatctcacaacgaactggctgatagtggaatacctggaaattctttcaatgtgtcatccctggttgagctggatctgtcctataacaagcttaaaaacataccaactgtcaatgaaaaccttgaaaactattaccctnggaggtcaatcaactttgagaaagnttgacataaaagagcttctgcaaggatcctggggccattatcctacctccaagatcaagcnttttgcggttgggattggcaatcgcattctcagaaaccagtcttcca

SEQ ID NO: 52253 - DNA, 340 bp, Homo sapiens
  misc_feature 10, 49, 202, 203, 204, 290: n = A,T,C or G
aactcaaggnaggctgggtttctgggcacccttgaagttttctggatgnctttttatctttctcgtgtgaactgcactacaaaagagaccagcccacttcccaagccagccagacacctgggtcttgagccataaactggcgtagttaagctttgcagcttccagtgtattttatttattcttttgttgggtttttgtttgnnncttcttgtaaaattgtacagaaactttttaaaagaaattggattcgaaactggatgtgtattcgtaacctcataatttttatttgngtattggttcttttattatttcagttaaatttttacattattttgcatgg

SEQ ID NO: 52254 - DNA, 430 bp, Homo sapiens
  misc_feature 53: n = A,T,C or G
ttcatccagaagtgtgtcttaagtaacttacgtgtcttaagtaacagggaccngagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaggattggcaaactttttctataaagggccagaaagtaactattttaggtttttaaacctactgtctctgtcataacttgtcaacactgctgtatgaagcacaaaagcagccatagacaatacataaacaa

SEQ ID NO: 52255 - DNA, 427 bp, Homo sapiens
  misc_feature 24, 182, 317: n = A,T,C or G
aagcagcagcctgtattgccgcangtctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctaggtggagcnactttctgtattgttacatggacatatgtagcaacacaagtcggaatagaatggaacctgtcccctgttggcaggagttaccccaaaggaatggaggaatcagtaatcatcccagctggtgtaataatgaattgnttaaaaaacagctcataattgatgccaaattaaagcactgtgtacccattaagatatggcattattgaagaaataaagtacatttgaaaccttcaaaaaaaaaaaaaaaa

SEQ ID NO: 52256 - DNA, 331 bp, Homo sapiens
cctacttctgactttacttgtggcgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaaaaaaaaaaa

SEQ ID NO: 52257 - DNA, 442 bp, Homo sapiens
gccatcccatgcaacaacaagggagctcactcagtgggtttaatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcat

SEQ ID NO: 52258 - DNA, 260 bp, Homo sapiens
  misc_feature 24, 145, 177, 178: n = A,T,C or G
tctataacttactaataatattcnatatgtactttatgtaatttccctaaaaagaatgaactaccactacactatggtgttaaaccaaaatatagggaaaataaacactaactgctgcttatggataatgttgcaacctacttgntatgcatataaatattttactttttcacatgnntagattgcatttcttaggtgttttaattttttaaatatatttatgttttaaaaatttaaaaaaaaaaaaaaaaaaaaaaaaa

SEQ ID NO: 52259 - DNA, 264 bp, Homo sapiens
  misc_feature 205: n = A,T,C or G
ttccacattgcatgttcactttagttatttgcaatttgatatatttcatggcgggcaaaatattagctctgtttttggacattttaaaatagaactatccttgttcgatagcataggaaaatgttctggtgattgtcagggtctcctaatatttatctcaattcttttataagtctatggaaattatttaattattttaaaacgnacacacttttcttgtaaatatgtcacatctgagtccaaaaaaattactttgaatacctt

SEQ ID NO: 52260 - DNA, 397 bp, Homo sapiens
  misc_feature 28: n = A,T,C or G
ctgcgaagagaggcgaagccaggtcacntttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaat

SEQ ID NO: 52261 - DNA, 346 bp, Homo sapiens
  misc_feature 31: n = A,T,C or G
ccttcccggcggtgacgacctacgcacactngaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagtaaggcttacagaaggatgttccttcaggaggaagcagcactaaaagcactctgagtcaagatgagtgggaaaccatctcaataaacacattttggataa

SEQ ID NO: 52262 - DNA, 359 bp, Homo sapiens
  misc_feature 21: n = A,T,C or G
ggaatcatgtctggtcgcggnttaggcggaaaaggcttggggaagggcggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcacctctgtatggcttcggcggctgaatctaagaatacgcggtctcctgagaacttcaaaaaaaaa

SEQ ID NO: 52263 - DNA, 175 bp, Homo sapiens
  misc_feature 24: n = A,T,C or G
gaccctcagggacctttaggactncaacaaaaattcatctgaatgctgggaagagaggagaaagagggtagggctgaaaagtactttcagaacactgactgaaaactccccaaatttagtagaaggcatatacctatatagatttaagaaactgagcaaatttcaaacaaaaaaa

SEQ ID NO: 52264 - DNA, 127 bp, Homo sapiens
  misc_feature 4, 19, 27: n = A,T,C or G
aagnacggttgaaactagnagatggtnaggttatcaacgaaacttctcagcatcacgatgaccttgaataaaaattgcacacactcagtgcagcaatatattaccagaaaaaaaaaaaaaaaaaaaa

SEQ ID NO: 52265 - DNA, 210 bp, Homo sapiens
  misc_feature 1, 15, 20, 26, 34: n = A,T,C or G
nggggtaaattccanggggntcaccncaattacntatgaaatatgaaaccattcaagcctagaataagctaggaatcgggggaaaattttctgattcaacatccagaagcaatgatgaaaaccttgatgatttgattatgttaaaaaattttttgcatggaaaaaaaccttgagcgaaaaaaaaggaaaattgcccaaaaaaaaaaaaaa

SEQ ID NO: 52266 - DNA, 137 bp, Homo sapiens
  misc_feature 7: n = A,T,C or G
aagtggnttactgtaaggctgaggaccatgcattcggcagctatgctgttgtctcttattttttctaacgtggaaatctgttttgtaacttgtagtaataaggtaggaaatcaaaaaaaaaaaaaaaaaaaaaaaaa

SEQ ID NO: 52267 - DNA, 150 bp, Homo sapiens
tgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaaaaaaaaaaaaaaaaa

SEQ ID NO: 52268 - DNA, 116 bp, Homo sapiens
tttgtcccccaccttgcgaggtaataaggcttttggtctccctggcaatggccggaggcagccagggcttacctgtacactgacttgagaccaggtgaataaaagtgcgcacctat

SEQ ID NO: 52269 - DNA, 118 bp, Homo sapiens
  misc_feature 50, 51: n = A,T,C or G
ggccgataactgacacctaagggacaaagagatctggacagaatcgccgnncaggtggcagctgcccacaagaagcattagaacaaaccatgctgggttaataaattgcctcattcgc

SEQ ID NO: 52270 - DNA, 389 bp, Homo sapiens
  misc_feature 210: n = A,T,C or G
tgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcntattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattggaccaaaaaa

SEQ ID NO: 52271 - DNA, 350 bp, Homo sapiens
  misc_feature 210, 281: n = A,T,C or G
agggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctntaatcagttacgagctgaactagagaaacatggttataagatggagacttcatagcatccagaaaaaggtntgaagtaacctaaacttgacctgcttaatacattctagggcagagaacccaggatgggacactaaaaaa

SEQ ID NO: 52272 - DNA, 321 bp, Homo sapiens
  misc_feature 25: n = A,T,C or G
tgcaatggggaaagcaggactgttnagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgtattgtgccgtggaagtacttgtgtgtgaatagcagtagtgggggcaaaagcaatcttctcatttggaaatgttgtaaataattttattatatagtgttttggatgtatttgttgtagaaatggaccagtgaataaaaaaaaaaaaaaa

SEQ ID NO: 52273 - DNA, 410 bp, Homo sapiens
ttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggc

SEQ ID NO: 52274 - DNA, 259 bp, Homo sapiens
gatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatat

SEQ ID NO: 52275 - DNA, 362 bp, Homo sapiens
  misc_feature 59, 247: n = A,T,C or G
gctctcggccttagcgccatttttttggaaacctctgcgccatgagagccaagtggagnaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaactncatcgccctctgatcgccgatcacctctgagacccaccttgctcataaacaaaatgcccacgttgggcctctgccctggacctgtgacattctggactatttctgtgttaatttg

SEQ ID NO: 52276 - DNA, 439 bp, Homo sapiens
taactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacgggttagatcctcaaaaaaataaagcaattgacctggcatga

SEQ ID NO: 52277 - DNA, 186 bp, Homo sapiens
  misc_feature 63, 167: n = A,T,C or G
gcacaaccattgagagatgttacaagaatgcagttaattttaacatgtgtgatgtgccgtggnggaaaagtactatcggaataactctgcagtgacagaatttgaagtttggtagcatccatacttttctactgtaaatatttcactctcctctagctatccttgangagctctcacttaaagaat

SEQ ID NO: 52278 - DNA, 322 bp, Homo sapiens
aaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctaagtagcatgccttacctacagcactatgtgcatttgctgcacaataaaagtatattttgtctt

SEQ ID NO: 52279 - DNA, 330 bp, Homo sapiens
  misc_feature 234: n = A,T,C or G
tcagccccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgngtatcatcggtgggatgacagaacaaacatatttatgatcatgaataatgtgctttgtaaaaagattcaagttattagggagcatactctggtttt

SEQ ID NO: 52280 - DNA, 309 bp, Homo sapiens
gaaactgtgtgagaagatggcccagtttgatgctaaaaagtttgcaagagtacctttgtgttggatgaatttaagcgcaagtactccaatgaggacacactctctgtggcactgccatatttctgggagcactttgataaggacggctggccctgtggtactcagagtatcgcttcgttgaagaactcactcagaccttcatgagctgcaatctcatcactggaatgttccagcgactggacaaagctgaggaagaatgccttcgccagtgtcatcctttttggaaccaacaatagcagctccatttct

SEQ ID NO: 52281 - DNA, 357 bp, Homo sapiens
  misc_feature 12, 44, 47, 54, 63, 66, 69, 317, 337: n = A,T,C or G
gtaaaccagtgntcaactagttttataactgaaaagctgcacanttntcacagnacaagccgnagnttntacctgtagtttggacttctctgttagaatgtaactgcattaccagcccttttaaaggcatctatctatcaaaggaaaatttgggtgttagattttcttgggaccgtttctgtaacctttgcccttcacaatatagaaaatattgggttttgccattacattttaatgccaggtttaaaacctgttgaaagctgcagctttatacagcttcttctccctgtgaaatcacttgtttatgtgaggcattnaaaaaatagcatgtcttttnaaactgaatttatatctaat

SEQ ID NO: 52282 - DNA, 359 bp, Homo sapiens
  misc_feature 175: n = A,T,C or G
gtctgcaagaaattgtccagtccttctaactacaagttggagtgcctgagactgactgtgagaaaggctggcactcttgaaatttggaggaaagtattatcaaaaggctaaagcggcttttgagaaggctctggaagtggagcctgacaatccagaatttaacatcggctatgcnatcacagtgtatcggctggatgattctgataagagaagggtctgtaaagagcttttctctggggcctttgagaaaggctggtaccctgaacccagataacagctatattaagggtttttctggcactgaagcttcaagatgacatgcagaagctgaaggggaaaagtatattgaagaaatcctg

SEQ ID NO: 52283 - DNA, 407 bp, Homo sapiens
  misc_feature 276, 299: n = A,T,C or G
gtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtaccgtggaccattgcttgcatgttaactttttgttttgttttgttttgttttgttttgcatttttaactccagatatcctaaagctcaattgtttggctctgggtttcatccttagagaagccatggagaacagactngaaaagttaggaaatcataatgngcagaggtggtgggaagaagaaagctgagctttttccccttgagaaacttctgcatttagtttctatctttccaggcaaaacaaatgggtattcttttcatacaacca

SEQ ID NO: 52284 - DNA, 226 bp, Homo sapiens
attttctctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttattt

SEQ ID NO: 52285 - DNA, 185 bp, Homo sapiens
  misc_feature 73, 150: n = A,T,C or G
gaaggccgcgcctgcctttcccatctgtctatctatctggctggcagggaaggaaagaacttgcatgttggtngaaggaagaagtggggtggaagaagtggggtgggacgacagtgaaatctagagtaaaaccaagctggcccaaggtgncctgcaggctgtaatgcagtttaatcagagtgcca

SEQ ID NO: 52286 - DNA, 444 bp, Homo sapiens
  misc_feature 7, 26, 50: n = A,T,C or G
gagaccnaaaaaagacattccatgcnaatggtaaccaaacatgagcaggnattgctctatttatatgagacaacatagactttacataaaaaactatcataagatacaaagaataacatcttataataataaaagataagtccaccagaaagatataacaattatgaatatatatacatcccacctcagagcacctaaatatataaagcaaacattgagaaagatgaagggagaaatagacagtaatacaatgatagcagatttcagtatcccacttctaataatggataaaacatatagatcgaaaatcaataaagaaacagaggcagggcgcagtgcctcatgcctataatctcagcactctgggaggctgaggcaggcagatcacctgaggtcaggagtttgagacaagcctggtcaacatggtgaaaccctgtctctacc

SEQ ID NO: 52287 - DNA, 227 bp, Homo sapiens
  misc_feature 77: n = A,T,C or G
gaaaggaaggcctagatccagccctggaggtagttcctttctgaggtctctcagtcccttgagactttggggtagtntggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgc

SEQ ID NO: 52288 - DNA, 414 bp, Homo sapiens
aacccggccttatggccgggattgcccaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccactgctgtatttaacatctgcctgcaaatgggcaaagtacttgatatggaggtggtcataaggagctactaactgggggttgcaccctacactctgggagcaacttagc

SEQ ID NO: 52289 - DNA, 151 bp, Homo sapiens
tttatgctcaccaaccccgaactgcagatgaaattcccatggaacctggagatatcattggtgtggctggaaatcattgggatggctattctaaaggtgtcaacaggaaattgggaaggacgggcctatatcccttctacaaagttcgaga

SEQ ID NO: 52290 - DNA, 452 bp, Homo sapiens
  misc_feature 357: n = A,T,C or G
gggtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgttnggaccaagaattcctgaaagttgaccaaggacacttttggaactcattctggctgcaaactactaaacatcaaaggtttgcttgatgttacatgc

SEQ ID NO: 52291 - DNA, 129 bp, Homo sapiens
  misc_feature 5, 73, 94: n = A,T,C or G
ggggncaaggaaaggaaacacaggagaagttttcagcagttgccccgagctgttttgtgtgtaatgaagtggnctttgattaaggagctctatntcttatttaactgatatcccactgccccactccac

SEQ ID NO: 52292 - DNA, 370 bp, Homo sapiens
  misc_feature 49: n = A,T,C or G
agtgaggaacactgtagctatttgtgttgggtaaatttgctggagctanatcttagtagaacttcagtttttagagttaatggagggagtggagtaaggatataattatttggtttgtggatatggtggtgacacttgatataacttaaagttaacttgatacgttatgcagcatcttactggttaaatttaagctagctctctggactaaaattcaggtaaaattcaatgtagagatgttcattttgtttttcaaattatttttgcttgatcttgtactaggtaaattaaaatgtccagaagaaaaatgcattttgttaacaattaaaacttctcagttgctgaaaaattaagattatgcaatagagcc

SEQ ID NO: 52293 - DNA, 264 bp, Homo sapiens
  misc_feature 27: n = A,T,C or G
atcgcgtggtgtattttttaaaaaatntgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccg

SEQ ID NO: 52294 - DNA, 407 bp, Homo sapiens
  misc_feature 25: n = A,T,C or G
gcagcgcaatctgggcgatcgcttnctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggcttcacgggcaaggcaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaat

SEQ ID NO: 52295 - DNA, 234 bp, Homo sapiens
atttggatgattgtcataaggtttttagcatgttcctccttttcttcaccctccccttttttcttctattaatcaagagaaacttcaaagttaatgggatggtcgggatctcacaggctgagaactcgttcacctccaagcatttcatgaaaaagctgcttcttattaatcatacaaactctcaccatgatgtgaagagtttcacaaatccttcaaaataaaaagtaatgaccc

SEQ ID NO: 52296 - DNA, 285 bp, Homo sapiens
  misc_feature 18, 129, 142: n = A,T,C or G
aatttaaagaaatatttntaaagccacaattattttaatattggatatcaactgcttgtaaaggtgctcctcttttttcttgtcattgctggtcaagattactaatatttgggaaggctttaaagacgnatgttatggtgcnaatgtactttcacttttaaactctagatcagaattgttgacttgcattcagaacataaatgcacaaaatctgtacatgtctcccatcagaaagattcattggcatgccacaaggggattctcctccttcatcctgtaaaggtc

SEQ ID NO: 52297 - DNA, 414 bp, Homo sapiens
  misc_feature 48, 374: n = A,T,C or G
ggatccctgaagctgacagcattcgggccgagatgtctcgctccgtgnccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgacttgtcacagcccaagatagttaagngggatcgagacatgtaagcaggcatcatggaggtttgaag

SEQ ID NO: 52298 - DNA, 401 bp, Homo sapiens
  misc_feature 6, 275, 345: n = A,T,C or G
atggangaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaacctnccatgtcaagattcagctagtggccaagagatgcagtgccaggaacccttaaacagttgcacagcatctnagctcatcttcactgcaccctggatttgcatacattcttcaagatcccatttgaat

SEQ ID NO: 52299 - DNA, 331 bp, Homo sapiens
  misc_feature 35, 50: n = A,T,C or G
gacgacctacgcacgcgagaacatgcctctcgcanaggatctccttcatncctctccagaagaggagaagaggaaacacaagaagaaacgcctggtgcagagccccaattccttcttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 52300 - DNA, 354 bp, Homo sapiens
  misc_feature 119: n = A,T,C or G
gggacccccagggactgtcggaggtgtggactctgcctgcctacctgttctgggaagatgttctaccatatctccctagagcacgaaatcctgctgcacccgcgctacttcggccccancttgctcaacacggtgaagcagaagctcttcaccgaggtggaggggacctgcacagggaagtatggctttgtaattgctgtcaccaccattgacagtattggtgctggtgtgatccagccaggccgaggctttgtcctttatccagttaagtacaaggccattgtttccggccatttaaaggggaggtcgtggatgctgttgtcactcaggtcaacaaggttggactcttcacag

SEQ ID NO: 52301 - DNA, 457 bp, Homo sapiens
  misc_feature 6: n = A,T,C or G
aataanagtgttaggagtataaatggtttggtagccaaccactactttaaaattgattaggtctcccgggcttctgggccttcacatttaaatttgacctgaccttgaaacttcacctctcgttattcccagcgtgacttttgttttacccacttttcgaaataccccatgtgtagctgcttacttcacgtcatgctggaatgtgacccataccagccaaactacatctaacagaaacataatacctaactaaaagcgtcttttatcatatagatagatgtacagggtatgttaatttatctttagagagactccccagtatactgaaaaaacagacctaagttttggaagataggccttgctttatagaaaatgaaaatggggccagacagggggtgactcattcctgaaatcccaacactttgggagggccaaggcaggaggatcacttttgagg

SEQ ID NO: 52302 - DNA, 335 bp, Homo sapiens
  misc_feature 120: n = A,T,C or G
tatggcaaaatcaataagaagcgaattgctttgacagataacgctttgattgctcgatctcttggtaaatacggcatcatctgcatggaggatttgattcatgagatctatactgttggnaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggtggttaataaacagtacctgctctcaaattc

SEQ ID NO: 52303 - DNA, 345 bp, Homo sapiens
  misc_feature 121: n = A,T,C or G
gagagaccaaaccgagaaaacagcatactctatcacttaagccttgggtagaatgggaattctttaccctgggtaaacgttttaacaaaaaaatggaacttaacttcggtttggactgtgntcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacgggacaaattgcttgtacaatttgaaatggcctcaatggtacttcaaaccttttgattattcctaaataaaaacat

SEQ ID NO: 52304 - DNA, 344 bp, Homo sapiens
  misc_feature 5, 177: n = A,T,C or G
gatancagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagntgacttctcagccacgtggtgtgggccttgcaaaatgatcaagcctttctttcattccctctctgaaaagtattccaacgtgatattccttgaagtagatgtggatgactgtcaggatgttgcttcagagtgtgaaggtcaaatgcatgccaacattccagtttttt

SEQ ID NO: 52305 - DNA, 371 bp, Homo sapiens
cataaagagcttctgcaagatcctggggccattatcctactccaagatcaagcatttgcgtttggatggcaatcgcatctcagaaaccagtcttccaccggatatgtatgaatgtctacgtgttgctaaccgaagtcactcttaattaatatctgtatcctggaacaatattttatggttatgtttttctgtgtgtcagttttcatagtatccatattttattactgtttattacttccatgaattttaaaatctgagggaaatgttttgtaaacatttatttttttaaagaaaagatgaaagggcaggcctatttcatcacaagaacacacacatatacacgaatagacatcaaactcaatgcttatttg

SEQ ID NO: 52306 - DNA, 300 bp, Homo sapiens
  misc_feature 266: n = A,T,C or G
attctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgtttnttggggtgggaggggagggtgtgttttttacacc

SEQ ID NO: 52307 - DNA, 379 bp, Homo sapiens
  misc_feature 6: n = A,T,C or G
gtctcntctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagccaaatgcgaaagaggcatgtcttctcaaaatctagcaaaggaagtagtctgcattgggtgtgcattacagtatttgcttaatgaaagcctcagttctgaatgttgaatgagtaggtaaaa

SEQ ID NO: 52308 - DNA, 459 bp, Homo sapiens
  misc_feature 24, 141, 142, 380, 402: n = A,T,C or G
aaccggccttatggccggggaatnggggccgtaccatggcggagaagactcaaaagagtgtgaagattgctcctggagcagttgtatgtgtagaaagtgaaatcagaggagatgtaactatcggacctcggacagtgatcnnccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggcttgttattcccaagccatgaagatgggagataataatgtcattgaatcaaaagcatatgtaggtangaaatgtaatattgcaagtggntgcatcattggggcttgttgcaacctaaatacattttgaagtcattccctgagaata

SEQ ID NO: 52309 - DNA, 311 bp, Homo sapiens
gattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgtaagaataatgtacttggtaatgtgtatttattgagtattgtt

SEQ ID NO: 52310 - DNA, 138 bp, Homo sapiens
  misc_feature 50, 97: n = A,T,C or G
gttcttatgagacgtccaaaacaaagaaacatgtcagcagggcctatggnggtccatgtgtgctaaatgtgttcgagacaggatcaagccgtgcttnccttatcgaggagcagaaaatcgtgtgaaagtgttgaaggc

SEQ ID NO: 52311 - DNA, 189 bp, Homo sapiens
tccagcaaactccgtgtcaacatctgtgttggggagagtggagacagactgacgcgagcagccaaggtgttttttctgctcacagggcagacccctgtgttttccaaagctagatacactgtcagatcctttggcatccggagaaatgaaaagattgctgtccactgcacagttcgaggggccaaggca

SEQ ID NO: 52312 - DNA, 350 bp, Homo sapiens
  misc_feature 23, 44, 47, 57: n = A,T,C or G
gaaaaagctggcggatttgcccncgtattatggagatgaaccantgnatttgaaaancaacaccgatgagattacgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggcagattctagtgctgagaagaacacgtttgg

SEQ ID NO: 52313 - DNA, 287 bp, Homo sapiens
  misc_feature 8, 26, 100, 113, 126, 152, 160, 167, 190, 191, 212, 219,225, 267: n = A,T,C or G
tacgtaanaatggaccacagtgactnatttgtagttgttagttgccctgctacctagtttgttagtgcatttgagcacacattttaattttcctctaatnaaaatgtgcagtnttttcagtgtcanatatatttaactatttagagaatganttccaccnttatgtnttaatatcctaggcatctgctgnnataatattttagaaaatgttncggaatntaaganataacttgtgttactaatttgtataacccatatctgtgcaanggaatataaatatcacaaag

SEQ ID NO: 52314 - DNA, 190 bp, Homo sapiens
gagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatccc

SEQ ID NO: 52315 - DNA, 473 bp, Homo sapiens
  misc_feature 42, 111, 117: n = A,T,C or G
gtccgacatcttgacgaggctgcggtgtctgctgctattctncgagcttcgcaatgccgcctaaggacgacaagaagaagaaggacgctggaaagtcggccaagaaagacntttttncagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctgccagggcagcccttcaggagctccttagtaaaggacttatcaaactggtttcaaagcacagagctcaagcaatttacaccagaaataccaagggtggagatgctccagctgctggtgaagatgcatgaaataggtccaaccagctgtacatttgggaaaaataaaacttta

SEQ ID NO: 52316 - DNA, 450 bp, Homo sapiens
  misc_feature 6, 20, 24: n = A,T,C or G
ggaacncggtggtggccacntgcncagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatcttgtctatctatctggctgcagggaaggaaagaacttgcatgttggtgaaggaagaagt

SEQ ID NO: 52317 - DNA, 301 bp, Homo sapiens
gttccattaaattgggatagcatactaagatgcctatcattataactaacatttgacattgttttggaggaggtggtagggaatgcaatttttttcttttttctttattacccaggttcccatcaatggtaaaggcaatgtaatttgaagagaaaaaggagacataaatataagagaagcagatgtgtcatgattcatgtttgcagatgacacaactttattcctagaataaagttattccaatcgaagcaaaagctacaagataaccttactttaagaaaaagaaatgaggaactaaaag

SEQ ID NO: 52318 - DNA, 134 bp, Homo sapiens
  misc_feature 62: n = A,T,C or G
gaccactttggatttcttttttgcgcgtggcacgttttaagatattagtttttaaaatcagnactttttaatggaaacaacttgaccaaaaatttgtcacagaattttgagacccattaaaaaagttaaatgag

SEQ ID NO: 52319 - DNA, 254 bp, Homo sapiens
  misc_feature 83, 100, 102, 140, 146, 150, 175, 178, 192, 194, 197, 215,241: n = A,T,C or G
aacacaaaaaaaagagggtaatgtacaagtttctgtatgtataaagtcatgctcgatttcaggagagcagctgatcacaattngcttcatgaatcaaggngnggaaatggttatatatggattgatttagaaaatggttnccagtncagncaaaaaagagaaaatgaaaaaaatncanctaaaaggaagaancncancttcaaagatttttcagngatgagaatccacatttgtatttcangataatgtagttt

SEQ ID NO: 52320 - DNA, 391 bp, Homo sapiens
  misc_feature 6: n = A,T,C or G
agagcnaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctaggaagaatttgagaagaaatactcctgtattgagttgtatcgtgtggggattttttaaaaaatttgatttagcattcatattttccatcttattcccaattaaaagtatgcagattatttgcccaaatcttcttcagattcagcatttgttctttgccagtctcattttcatcttcttcatggttccacagaagcttggttct

SEQ ID NO: 52321 - DNA, 105 bp, Homo sapiens
  misc_feature 23, 39, 47: n = A,T,C or G
aaccgtgaacaaaactgtggttngagtttagctgacatnaaagaaanaagttcatcacgtgactgttaatgtaaacctggttattaaaataactatgaaattacc

SEQ ID NO: 52322 - DNA, 372 bp, Homo sapiens
  misc_feature 5, 344: n = A,T,C or G
aatgncaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaaagtcagaacagtagactcagctcttgacattctgattcgaatgacactgtcaggaatcggaatcctgcgataaactgacagctngggcaagtgaatttgcctgaacaagcca

SEQ ID NO: 52323 - DNA, 485 bp, Homo sapiens
  misc_feature 247: n = A,T,C or G
gactgaactcacaatgttttaaatacatattttctagctgtgtccgcgaagagggcattaagcaataacagacaagcacaatgactacgtctatggcctggacctcggtgtccagatggctttctgcactaaaaggaacccaggcgctctggagaagcagctgacgcaggcctgggaaagacatcaccgtgagcctgggacgctgggccagaaaggatgcattcccaggaccacgtacggagtgaanaggacacaggggccagcttggaaggggctcccaactagtcacatttatagctatttgagcatcacaaaacaaaaggctttactagattatgacatggaataaataaaatccactagtccaccttgatctcaaggaagacaaagggaaaagtaaaaattgcccccacagaggggctactagaccatcttccgctaagaattgggaataaagagaaagaactcagcattttctaagaggt

SEQ ID NO: 52324 - DNA, 189 bp, Homo sapiens
tacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattcaca

SEQ ID NO: 52325 - DNA, 549 bp, Homo sapiens
  misc_feature 416, 418: n = A,T,C or G
gaggcattgaggcagccagcgcaggggcttctgctgagggggcaggctggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagttagtttaaaagtgnanggtgattaaaataatttgaagcgatcttttaaaaagagattaaccggaaggggattaaaagaccttgaaatccatgacgcagggagaattgcgcatttaaggcctagttacgcatttactaaacgccgccc

SEQ ID NO: 52326 - DNA, 280 bp, Homo sapiens
  misc_feature 184: n = A,T,C or G
ctttgtttactgctggctcatcatgcacttttccttcatagcctattttaagaagttgatttgctgaactgctttttagccaagctatttgtaaatcaagctacacaaagtatgtggccataatttccaaaaggcaaatgatcattgttcaattgctgttgtctgcagtgtgcattcatgcagntaaaaattgtactgcattgatagtacggcatcagagaatagatcacttaggttcaaatcccagtgcatgatcctgagcaagatatcatatctagat

SEQ ID NO: 52327 - DNA, 349 bp, Homo sapiens
  misc_feature 40, 148, 149, 159, 190, 199, 204: n = A,T,C or G
caaagctaagacccccgaaaccagacgagctacctaagancagctaaaagagcacacccgtctatgtagcaaaatagtgggaagatttataggtagaggcgacaaacctaccgagcctggggatagctggatgtccaagatagaatcnnagttcaactntaaatttgcccacagaaccctctaaatcccnttgtaaatntaacngttagtccaaagaggaacagctctttggacactaggaaaaaaaccttgtagagagagtaaaaaaatttaacacccatagtaggcctaaaagcagccaccaattaagaaagcgttcaagctcaacacccactacctaaaaaatccc

SEQ ID NO: 52328 - DNA, 540 bp, Homo sapiens
atgaatgattgaggtacctgaaagagacagggagaatggaaccaagttggaaaacgtacttcagaatatcatccaggagaacttccccaacctagaaagacaggccaacattcaaattcaggaaatccagagaaccccagtaagatattccatgagaagatcaaccccaagacacacagatcatcagattttccaaagtcaaaatgaagaaaaaaaatgtttagggcaacctgaaagaaaggttcaggccacctagcaaaagaagcccatcagactaacagcagacccccctcagcagaaaccctacaagctagaagagattgtgggccaattttcaacaacttaaaaaaatttccaaccctgaattttatatctagccaaactaaacttcctaagtgaagggagaaataaaatcattttcagacaagcagatgctgagggaatttgttaccactaggcctgccttgcaagtgctcctgaaggaagcactaactgtggaagggaaaaactgttaccagccactaaaaaaacacattgagg

SEQ ID NO: 52329 - DNA, 467 bp, Homo sapiens
  misc_feature 6, 426, 428, 461: n = A,T,C or G
tctccntctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggccaaatatgaagaggaaaatttctaccttgaccgtatctgaaagaggttattcgggaaagaaaagaaagagaagaatgggcaaagaagtaatcatgtagttgaagtctgtggatgcagctgttatgaagatggttaaacttgaaacaaacaattttaagaattattngnctgaagatgttttacttaaataaatgctattgnaatggc

SEQ ID NO: 52330 - DNA, 251 bp, Homo sapiens
  misc_feature 27: n = A,T,C or G
cgatcgcttcctggtcctcgcctcctncgctgtctccctggagttcttgcaagtcgccaggatgtctcaggctgagtttgagaaagctgcagaggaggttaggcaccttaagaccaagccatcggatgaggagatgctgttcatctatggccactacaaacaaggcaactgtgggcgacataaatacagaacggcccgggatgttggacttcacgggcaaggccaagtgggatgcctggaatgagctgaaa

SEQ ID NO: 52331 - DNA, 400 bp, Homo sapiens
  misc_feature 345: n = A,T,C or G
aacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggttttaaaaagaaaagtgtaatgcaagaatttaaagaaatatttttaaagccacaattattttaatattgggatatcaactgcttgtaaagggctcctctttttctngcattgctggcaagatactaatattgggaaggcttaaagcgcatgtatgggctaa

SEQ ID NO: 52332 - DNA, 414 bp, Homo sapiens
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttaagattaaaatgaagggacttaaacagcttaaagttaagtttaaaagt

SEQ ID NO: 52333 - DNA, 265 bp, Homo sapiens
tacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagt

SEQ ID NO: 52334 - DNA, 337 bp, Homo sapiens
  misc_feature 12, 56: n = A,T,C or G
agtgccgcttgnactattataatttaatgcatgttaggaaaatttcacattaatanttgctgacagctgacctttgtcatctttcttctattttattccctttcacaaaattttattcctatatagtttattgacaataatttcaggttttgtaaagatgccgggttttatattttgatagacaaataataagcaaagggagcactgggttgactttcaggtactaaatacctcaacctatggtataatggttgactgggtttctctgtatagtactggcatggtacggagatgtttcacgaagttgtcatcagactcctgtgcactttcccaatgt

SEQ ID NO: 52335 - DNA, 423 bp, Homo sapiens
  misc_feature 6: n = A,T,C or G
gagacncaagacgccgggcctacagcgggagcgtgaggaaagccgtgcgttgcggttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaaccgagtataaataatggctggtcagcagagaacccatgtcctctctccatagggcctgttttactatgatgtaaaaattaggcatgtcatttcatattagactttttggta

SEQ ID NO: 52336 - DNA, 217 bp, Homo sapiens
ggcatgcaccaccatgccttgctaagtttttgtgtttttggtggagatggggttttgccttgttggccgggtcgggctcggactcctgaactgaggtgatccatcctcctcggcctcccagagtgctgagattgcaggcatgagccaccgcgcccagccttatcttggatttccagactccataaccaagagaagtaaatttctgttgtttaagccg

SEQ ID NO: 52337 - DNA, 357 bp, Homo sapiens
  misc_feature 307: n = A,T,C or G
gaatgcagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacgacagattcttaccgtctccacaaaggtcagagattgcaaatggtcaatactgactttttttttttnttcccttggctcaagacagctaacttcattttcagaactggttttaaccc

SEQ ID NO: 52338 - DNA, 300 bp, Homo sapiens
  misc_feature 70, 237: n = A,T,C or G
ggtactacttctggattaggcagaaaacaccaggattccttaagtgatccttgaaatgggttattgtttnctgccttgtcacatttgccactgtgccctttaaaacgatgtggaaacctcaggtttgtgggacagcacaggtggaatgacatcttgtgcttcctggggctcccctctaccaggcacattagcttagtgcttcagatgtcaagcccaagtccttgttaccttcttttnctgctgcccagggaagaagtgtgtgtgctggagctggagcgcttgcactcttcaggtgactat

SEQ ID NO: 52339 - DNA, 317 bp, Homo sapiens
  misc_feature 15, 16, 106, 158, 242: n = A,T,C or G
atctccggttgtagnntctaattttcactgcataacaaatttgaaaccaaatgttgaatttctctgtgagggtacttattttgcctgcagtgttcaaatatatttncaaattcatctccttcttactagactgcgagctccttgtggacaaggatgtnattttagttataatgacaactttaatatctagcaaagtgccaggcatagagtattcctttattgaaatgaattgataagatatngattattaaaatgctactacagtattctacgatgcaggctggaatgtatattacagtaattctctggctaatttt

SEQ ID NO: 52340 - DNA, 163 bp, Homo sapiens
  misc_feature 92: n = A,T,C or G
tggttatcactaggctaaaactggacaaagaccgcaaaaagatcctcgaacggaaagccaaatctcgccaagtagggaaaggaaaagggcangatacaaggaagaaaccattgagaagatgcaggaataaagtaatcttatatacaagctttgattaaaactt

SEQ ID NO: 52341 - DNA, 419 bp, Homo sapiens
gacaccgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggcaacagaataatattggaatgggtggtaatacgaggaaatagtatcatcatgttagaagccttggaacgagtataaataatggctgtcagcagagaacccatgtcctctctccatagggctgtttactatgatgtaaaaattaggcatgacattttcatattagacttttggtaaataaacttttgtaatagtcg

SEQ ID NO: 52342 - DNA, 501 bp, Homo sapiens
  misc_feature 416: n = A,T,C or G
gttcagggccagtgcatattagtggacagcacttagtagctgtggaggtagatgcagagtcagaagatgaagaggaggaggatgtgaaactcttaagtatatctggaaagcggtctgcccctggaggtggtagcaaggttccacagaaagaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaacaggaaaaaactcctaaaacaccaaaaggacctagtctgnagaagacattaaagcaaaaatgcaagcaagtatagaaaaagcgcattgaacagcctggcactacatgtaaattaagcccaaagat

SEQ ID NO: 52343 - DNA, 422 bp, Homo sapiens
  misc_feature 171, 180, 187: n = A,T,C or G
ggcccatggttcagcaaaggtttccagaatccacatttagtgtgtgaaaagtctaagtggctgtatggctgcttggcatttgatcttgattatttggcaagaatgggatttcaaaataatatttctcgatggtaattttttcaattaatgtctctgtaaaagtttctttgnaaatactgnatgtttnagtgtgcttgagattccaaacaaaatgatccctgcatttcctcaaggtggctgacgtaacagattgagtaagcagtcttgggcaagagatgggaaatgcagaaaaaaggttttgtctggttgcatatagtctttgctctttttaagctctgtgagctctgaaatatatttttgggttactcagtgggttgacaagacagcttgatgttctatcaacaaatgacttcatatgcaac

SEQ ID NO: 52344 - DNA, 175 bp, Homo sapiens
cactccgtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagt

SEQ ID NO: 52345 - DNA, 512 bp, Homo sapiens
  misc_feature 380, 415, 417, 499: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaagngacttaaacagcttaaagttaagtttaaaagttgnanggtgattaaaataatttgaaggcgatcttttaaaagagattaaaccgaaggggattaaaagaccttgaaatccatgacgcanggagaattgcgca

SEQ ID NO: 52346 - DNA, 323 bp, Homo sapiens
  misc_feature 37, 40, 54, 223: n = A,T,C or G
gatgaattggtagaagaaatggaacattacggcaaanggnctgggggaaaacancatgatagccgtatatctggtggtatgaaaatgtcccaactgatgatatccacatgaagcaagttgatctggagaatgtatggcttcattttatccgggagttcattgcaccagttacactggaggtctttgcaggctattatacgaagggatttgcactactgaattntgtagtaaaatactcccctgaacgacagcgttctcttcgtcctcatcatgatgcttctacatttaccataaacattgcacttaataacgtgggagaagac

SEQ ID NO: 52347 - DNA, 430 bp, Homo sapiens
  misc_feature 5, 340: n = A,T,C or G
gcttnccctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggcaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggcagggcaagcccttcaggagctccntagtaaagggacttatcaaactggtttcaaagcacagagctcaagtaatttacaccagaaataccaagggtggagaatgctccagctgct

SEQ ID NO: 52348 - DNA, 278 bp, Homo sapiens
aaaaacaaaaatgagattcctacactttgcctaattgagccactaccaggttttctggcagctgtggccacattatttgtgagatgatttttttttctttatgttcagagtgacttttgattctgattctttatgttttgtatggagcggcacttttatctgtgttttagcagaactgttcctctgtatcctttacggtttttctttgtttttgtttcctttttaaattatgcatagagttttttgtgtgtatgaaattaaagcctttattaacctac

SEQ ID NO: 52349 - DNA, 350 bp, Homo sapiens
gatacattggctctaagaggatatattttgagaccaatttaatttcatttataagaacatagtaattaagtggactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgacccacta

SEQ ID NO: 52350 - DNA, 418 bp, Homo sapiens
  misc_feature 172: n = A,T,C or G
gtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcanacaaccactattttgatttgatcatcataaatgataatctagacaaagcctttgaaaaactgcaaactgccatagagaaactgagaatggaaccacagtggggtcccaatcaggctgggtttactgatgattcaggtaaggttaacaatgaaaattaaactcttaaaaaggactgcaacaaataaaccttctactgagaaaatacatcacagatagaagattatctgctaagtccagcatttttat

SEQ ID NO: 52351 - DNA, 170 bp, Homo sapiens
  misc_feature 33, 41, 62, 77, 89, 108, 121, 149, 167: n = A,T,C or G
actcaaaatacaaaaaaaaaattagccaggcanggtggtgngtgcctgtagccccagctacncgggaggctgatacnggggaatgtcangaacccaggaggcagagcntgcagtgagccangatcacaccaccacactccagcctgggngacagagcgagactccgnctc

SEQ ID NO: 52352 - DNA, 389 bp, Homo sapiens
cgaactcctgacctcaggtgatccaccgcctaggcctcccaaaaccattagggctcagaggaaggtatcccgatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgccaatctggtgaatgtctaaccctaaagtttaaaaatttctgcctcctaagttatgtaccttgtttccatccatttaccacatatttccatctgataatctagcagggtaattaaacttatatgt

SEQ ID NO: 52353 - DNA, 246 bp, Homo sapiens
  misc_feature 103, 129, 132: n = A,T,C or G
ggagggagtttaagagaaaggacccttcccaaccagcagccagtagaaaatacaacctactcacctttttcccttctaagttctgctaaatcacatctgcctnatagagaaaggaatgttgctttgagnacngcttggagaacagataagcttgaaatgttctctctagagaggacatagggttgggatcctctgaaaaggcccagaaaaatagctcagtcaaatacaatggtctaggacaattgg

SEQ ID NO: 52354 - DNA, 348 bp, Homo sapiens
  misc_feature 90: n = A,T,C or G
cattattactgctgttagcagtcgttttcaccaggtacttacagagcagatttcatacatcattcattcaagggctaaatttatattttntggaaatcatggcaactacacaggatgttgcttaccaggacggagttttggtatcttagtactgaagttagcactatgtttacatgcaaaagattaaggaaaaaacccttaaagtggcaggtatccaaagtcattttctgtgactcatcaaagtgacaaaagacttgtaacaactttgcctggctttttcatttacaacagtcatccatcacaatgatttggtctctgctccatatttttaaatccctaagcattgga

SEQ ID NO: 52355 - DNA, 183 bp, Homo sapiens
  misc_feature 20, 126: n = A,T,C or G
ttttcagcaacccggtcagnactgggagatacagccatccaccttcagatgtgtctaccgtgcgctctgcattcaactcggaaactataagtaattctcaagaaagccctcatttttataacctgncaaaatcttgttaatgtcattgctaaaaaataaataaaagctagatactggaaacct

SEQ ID NO: 52356 - DNA, 399 bp, Homo sapiens
gtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctaacttcacagagaatgcagttgtcttgacttcagatgcaaccttaaaatcagtgacaagaaacattccaaacaagcaacagtcttcaagaagttaaactggcaagtggaaatgtttaaacagttcaagtgatctttagtgcattgttatgtgtgggtttctctctcccctcccttgtcttaattcttacatgcaggaacactcagcagacacacgtatgcgaagggccagagaagccagacccag

SEQ ID NO: 52357 - DNA, 372 bp, Homo sapiens
  misc_feature 12, 24, 69, 140, 269: n = A,T,C or G
acccggccattntggccgggggtnccctactaaagaaagattatatataactatgctaattgttcatantcaacagaaaccaagatagagctacaaactcagctgtacagttcgtacactaaactcttcttgcttttgcnttataaggaattaagtctccgattattaggtgatcaccctggatgatcagttttctgctgaaggcacctactcagtatcttttcctctttatcactctgcattggtgaatttaatcctctcctttgtgntcaacttttgtgtgcttttaaaatcagctttattctaagcaaatctgtgtctactttaaaaaactggaaatggaaaaaaaaataaatctttgccaaatcctgc

SEQ ID NO: 52358 - DNA, 231 bp, Homo sapiens
atatccaaaggttgaaaaaattaaccttgacctaaaccacacaccttatacaaaacccaactccaaatgcatcatggacttggaaggtaaagtgtaaaattaaatcttctggaaaagaacacaaaagaataactttgggacctatgactaggcaaagagacttgacttctcttagacttgacaacaaaactgtgatctgtaagagaaaaatctggtaaatctgactgcatc

SEQ ID NO: 52359 - DNA, 480 bp, Homo sapiens
caaccccaaactaaattacatttcagactttcctcaggctggagggattggggaaggaccttcagttttacagtttcaaaagcattttcaggaaaattgactaatttaggcctcacaccaactccgtgaggcagctagggcaggagtcactgcaggaagtgtccaatttatgaaagtgaatatattccaaatgtggctatattctttttggaaaaagagcaccatttctcacagaaacagcattcctaatggtagacagtttccaggccagcttacttcaccagcatgtaatagtctaatccaactcagaggacagaaacacagcttcatcccacataagcaggagggtggtgtcacaggggatctcaaagtcacttgcctctaagtgacatttgctaacagacaaatgcctctacaagaggccccctaagattccaaggaaaggattcacaggaacgcattagtaaaatagcatcctag

SEQ ID NO: 52360 - DNA, 378 bp, Homo sapiens
atgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctcttgctgtgatatgatagatgtgggttattgacatctcttgtatttatggtctcaaagaagatggagcaggaaccccctatgacaaggaatccacagccatcataaagcttaataatacaaccgtgctttatttaaaaga

SEQ ID NO: 52361 - DNA, 333 bp, Homo sapiens
ggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctggatcatcaaaagccctcaagga

SEQ ID NO: 52362 - DNA, 164 bp, Homo sapiens
  misc_feature 80, 121, 122: n = A,T,C or G
atcgcaaaaccttcagaaggaaaggagactgttttgtggaccactttggttttcttttttgcgtgtggcagttttaaggnattagtttttaaaatcagtactttttaatggaaacaacttnnccaaaaatttgtcacagaattttgagacccattaaaaaagtt

SEQ ID NO: 52363 - DNA, 214 bp, Homo sapiens
  misc_feature 47: n = A,T,C or G
gcccaatagatgcttcgaaaggcaaggaggaagcttatctatgaaanagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgt

SEQ ID NO: 52364 - DNA, 220 bp, Homo sapiens
  misc_feature 5, 48, 122, 124: n = A,T,C or G
atgancggtgagcagaagttctccagcctccccctgggccgggaggcngtagaggctgctgtgaaagaggctggctacacaatcgaatggtttgaggtgatctcgcaaagttattcttccancntggccaacaacgaaggacttttctccctggtggcgaggaagctgagcagacccctgtgatgcctgtgacctcaattaaagcaattcctttgacctg

SEQ ID NO: 52365 - DNA, 273 bp, Homo sapiens
  misc_feature 5, 179: n = A,T,C or G
ttaangaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaancttaatgttcctcaaagcttggattaaatacatatggatgttactctcttgcaccaaattatcttgatacattcaaatttgctggttaaaaaat

SEQ ID NO: 52366 - DNA, 300 bp, Homo sapiens
  misc_feature 1, 9, 56, 179, 183, 274, 296: n = A,T,C or G
ntatacatntgaatgaaaagcaaagctaaatatgtttacagaccaaagtgtgattncacactgtttttaaatctagcattattcattttgcttcaatcaaaagtggtttcaatattttttttagttggttagaatactttcttcatagtcacattctctcaacctataatttggaatantgtngtgggcttttgttttttctcttagtatagcatttttaaaaaaatataaaagctaccaatctttgtacaatttgtaaatgttaagaattttntttatatctgtaaataaaaatnattt

SEQ ID NO: 52367 - DNA, 329 bp, Homo sapiens
gtttccgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattaga

SEQ ID NO: 52368 - DNA, 198 bp, Homo sapiens
  misc_feature 6: n = A,T,C or G
gtctcnctcaacatagcaaaactctgcctctactaaaaacaaaaaagttagccaggtgtggtggcccacagctgtagtctcagctactcaggaggatgaggtgggagaatcacctgagccccggaagtagcggctgcagtgagccgagatcacgccactgcactccagcctgggcaaccagagtgagaccctgtctcc

SEQ ID NO: 52369 - DNA, 322 bp, Homo sapiens
  misc_feature 297: n = A,T,C or G
gtaaactatcagattttaaaagtacctttttaattaaatagttttttcaatatagcattaatagagcaagtatattaatacatttatatatacagtttctaatactaaagtaaaacttaatcatttaaaaatactatacagagtgatatcaagaattaagtatggaaaacttgcccaacagaaaatgttgatttaatatagttcaatactatgctggtaaataatggaaacattttgaaataaaaggctgaatgtagttaggattgtgttacaaagcacataattaaaatgttgctntcagcatattagtctttctgataac

SEQ ID NO: 52370 - DNA, 347 bp, Homo sapiens
  misc_feature 50, 65, 83: n = A,T,C or G
aatggggaagcctgtgatgactacagactttgcgaacgctacgccatggnttatggatacaatgntgctataatcgctacttnaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggcaaaggagagtcaacatatgtgattgttccataataaacttctggggtgat

SEQ ID NO: 52371 - DNA, 398 bp, Homo sapiens
  misc_feature 2, 4: n = A,T,C or G
gngnccaactgaaatcataccaaatacatactgagatcacagtgcagttaaaatagaagactaagaaaattgctgaaaatcatgcaattacatggaaatcaatcaacatgctcctgaatgactttttaataaataatgaaattaaggcagaaatcaagaagctctttgaaaataatgagaacaaagttacaacatactagagcctctggacacagctaagacaatgttaggagggaaatttatagcactaaatcccacatcaaaaagttaggaagaactcaaattaataacctaacatcacaactgaaagaactagagaagcaagacaaaaccccaaagctagaggaagacaagaaataactgaaaatctgagctgaactgaaagaaaccgagacatg

SEQ ID NO: 52372 - DNA, 233 bp, Homo sapiens
  misc_feature 179: n = A,T,C or G
gggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatcnattctgtatgatgagcgaagtgtacacaaagtagaaccaattaccaagcatata

SEQ ID NO: 52373 - DNA, 354 bp, Homo sapiens
  misc_feature 6: n = A,T,C or G
gaaacnataaaaccatgtggttttgttagacatacagataattgaaaaagaataaaatagtccaaaaataggcctagcaattgttataagcataataataatgaattagaggtaatttcttatataaggagaactcagaaataaaaatcaaataattacccaaaatattaacgtatttgtcatataaaacctttacacataaaaaaaggcaaaaaaaatcaggagaaaaatatgttaaggctctctgtgtcatattgaccatatctttattttctaaatcaattattaacctatattaaaatttaataaacatgagaagtattggtgatcaagcaatctcctctctccaaaaac

SEQ ID NO: 52374 - DNA, 103 bp, Homo sapiens
  misc_feature 16, 41, 55, 68, 76, 88, 89, 90, 101: n = A,T,C or G
tatcccgatctttttngaggctcagggagaaactagcattntttttttccaaacnactttttgtcacngtgacagntgaaaataaagnnngaaaatgcttncc

SEQ ID NO: 52375 - DNA, 322 bp, Homo sapiens
  misc_feature 90: n = A,T,C or G
ctcacaaatgagggctgcacattgcctgttctgcttcgaagtattcaataccgctcagtattttaaatgaagtgattctaagatttggtntgggatcaataggaaagcatatgcagccaaccaagatgcaaatgttttgaaattatatgaccaaaattttaagtaggaaagtcacccaaacacttctgctttcacttaagtgtctggcccgcaatactgtagggaacaagcatgatcttgttactgtgatattttaaatatccacagtactcactttttccaaatgatcctagaaattgcctagaaatatcttctcttacct

SEQ ID NO: 52376 - DNA, 203 bp, Homo sapiens
  misc_feature 32: n = A,T,C or G
gtgatctcaggagcgtatataattgaagtaantcctgataccccagcagaagctggtggctcaaggaaaacggcgtcataatcagcatcaatggacagtccgtggtctccgccaatgatgtcaagcgacgtcattaaaagggaaagcaccctgaacatggtggccgcagggggaatgaagatatcatgatcacagtgattccc

SEQ ID NO: 52377 - DNA, 241 bp, Homo sapiens
  misc_feature 6, 91, 151, 164: n = A,T,C or G
agcaangatttctcttctctggaggctttgtgtaagaaaatcattaaagaaaaacaagcttttgaaagactggaagttaagaaagaaactntactggcaatgtttaagtacaacaagttcaaatgccggatattgaatgaaataaaaggtngtttggattttcnacgtacggtatatagcgtatttggattttcttttaaactaaacctttctactcgcccggaaaaattccttggagata

SEQ ID NO: 52378 - DNA, 414 bp, Homo sapiens
tgctcctatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgtcctggcagtttaaaaaaattggttggagaatttaggtttttattaagtaccatagtaccatttatacaaattagaaaatgttatttaacagctgaattatctatacatatctttattaatcactattgttccagcagtttcaagtcaaataaataatctaattaggggagaaaattcaatggtaaattgg

SEQ ID NO: 52379 - DNA, 267 bp, Homo sapiens
gataccacattaacaaagtgatcatagttaccaccaccaatattgtaataaactttcatttcctgtgtctcctgatatgatgcatggagaaggacacagcatcgcctctgtaatattcccactaaaatgcgtgacctcaattgaattatgaggaaacatcagacaaattcaacatgtgggtaaaaatttttaacaaaatgaccggctacattcttcaaaagtgccaaagtcatgaaaaagaaagactaagtagtggttccatttttc

SEQ ID NO: 52380 - DNA, 259 bp, Homo sapiens
  misc_feature 6, 177, 180, 181, 191, 223: n = A,T,C or G
ggcacntagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagnaannctagaattanttataagaattactcattgaactaattctacnatttaggaatttgtaagagtccaacataggcttagc

SEQ ID NO: 52381 - DNA, 412 bp, Homo sapiens
  misc_feature 120, 244: n = A,T,C or G
gattcccgttggtggtgttcagttgtggcggttgctggtcagtaacagccaagatgctgcggaatctgctggctcttcgtcagattgggcagaggacgataagcactgcttcccgcagcnttttaaaaataaagttccggagaagcaaaaactgttccaggaggatgatgaaattccactgtatctaaagggtggggtagctgatgccctcctgtatagagccaccatgattcttacagttggnggaacaagcatatgccatatatgagctggctgtggcttcatttcccaagaagcaggagtgacttcagcatcccagcaatcgcttggttcagtttcattcagctctctatggaccagtaatctgataaataaccgagctctttctttggggatcaatattaattgactt

SEQ ID NO: 52382 - DNA, 244 bp, Homo sapiens
  misc_feature 5, 51, 106: n = A,T,C or G
atacncagtcaatctagttgtggacaagttggtccttgcactctccttggnaggaagcctgtttcctgctgcttgctgatttctgagctaagcaggggaggaaggnggttagtctaggtctccactgacccttaactacaaataatacaaaaagcccaccaatctgttccatgccccataaacaaggactgactgtatttagccttgtattttgtctccctagaaccttatctcagagcccgcc

SEQ ID NO: 52383 - DNA, 202 bp, Homo sapiens
  misc_feature 107, 110: n = A,T,C or G
actcagagggaccacttggggccagccagactggcctcaatggcggactcagcacattgactgacggggaccagggcttgtgtgggtcgagagcgccctcatggtgnttntgctgttgtgtgtaggtcccctggggacacaagcaggcgccaatggtatctgggcggagctcacagagttcttggaataaaagcaacctccg

SEQ ID NO: 52384 - DNA, 213 bp, Homo sapiens
  misc_feature 30, 32, 37, 41, 111, 119, 128, 129, 138, 168, 175, 197: n = A,T,C or G
gcttcaatcaaaagtggtttcaatattttntntagtnggcnagaatactttcttcatagtcacattctctcaacctataatttggaatattgttgtggtcttttggttttnctcttagnatagcattnntaaaaaaanataaaagctaccaatctttgtacaatttgnaaatgcnaagaattttttttatatctgtnaaataaaaattatttc

SEQ ID NO: 52385 - DNA, 287 bp, Homo sapiens
  misc_feature 75, 79, 179, 287: n = A,T,C or G
gatatatttaatgatgatcgctgcataaatatcaccaaacagactccatcattttggattttagctcgtgccttntttngaatttgtggccaaagagggtcaaggaaatttacctgttcgaggcacaattcctgatatgattgcagattcaggcaaatatataaaactgcaaaacgttnaccgtgaaaaagcaaagaaagatgctgccgctgtgggtaatcatgttgccaaattgctgcagtccattggccaggcaccagagtccatttcagagaaagaattaaaan

SEQ ID NO: 52386 - DNA, 109 bp, Homo sapiens
  misc_feature 11, 33, 73: n = A,T,C or G
acccccaactngagatgaatgaaggcttttggnctccctgggagtgggtggaggcagccagggcttacctgtncactgacttgagactagttgaataaaagtgcacacc

SEQ ID NO: 52387 - DNA, 395 bp, Homo sapiens
  misc_feature 6, 16, 33, 45, 107, 120, 121, 149, 342: n = A,T,C or G
gggacnaaacgcgganccatggccgctgtggtngctgattgcggnggtctagggaggaagaagttgacacacttggtaacggctgctgtcagccttacacatcccgngactcacacggtnntttggagaagaggttgttcacaacaggnatccagcaatgaggacctgcttttgtcccagtttgtttctccatttactgggatgcatttatggaaggcacattacaggtctttgtgggaagaaacagaaagaaatcacaaaagcaattaagagagctcaaataatggggtttatgccagttacatacaaggatcctgcatatctcaaggaccctaaagttgnaacatcagatatcgggaataaatctatcacgttaccactaataaacttatttt

SEQ ID NO: 52388 - DNA, 301 bp, Homo sapiens
  misc_feature 58: n = A,T,C or G
tccccgccccacccggcctgataaagcgcgccgactgggctacaaggccaagcaaggntacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactggggtggtgaagattccacatacaaattttttgaggttatcctcattgatccattccat

SEQ ID NO: 52389 - DNA, 440 bp, Homo sapiens
  misc_feature 114, 115, 116, 167, 182, 423: n = A,T,C or G
aggttaacattgctccactgttcaccaaggaagggggcagtgccatccgccgcggcctcacgtgcgttgtaacaagccctcatcacatgtgtgagtcttacgtgcacaaaaagnnnaggctttggtactgaaactggacaccttgtgtactcgataccttcacagcntctattggcatattntctttttaggaatgaaggaaaattctcccatttttgagccattcttttgtcaattctacaaaattgcatgtaactttataaatatttttaaaagatatagttttgtaaatatttaatattccgctaatttgatttgaattgtaaatgtcaagtattctgtttttgggggttttatgtttattatacttggtaaaaaggacaaattgacatttttaagaatgttttatgagtaaattaatgnactgaaaataaaaattt

SEQ ID NO: 52390 - DNA, 334 bp, Homo sapiens
gaccccttgaatgatgcacttgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtaagcatgttttgtgtatataaaagggagggtttttttaaaaatatattcccagattatccttgtaatgacacgaatctgcaataaaagccatcagtgct

SEQ ID NO: 52391 - DNA, 258 bp, Homo sapiens
  misc_feature 90, 94, 109, 110: n = A,T,C or G
tcacagcccaagatagttaagtgggatcgagacatgtaagcagcatcatggaggtttgaagatgccgcatttggattggatgaattccanattntgcttgcttgctttnnaatattgatatgcttatacacttacactttatgcacaaaatgtagggttataataatgttaacatggacatgatcttctttataattctactttgagtgctgctccatgtttgatgtatctgagcaggtgctccacaggtaagctcta

SEQ ID NO: 52392 - DNA, 345 bp, Homo sapiens
  misc_feature 23, 26, 42, 60, 115, 116, 133: n = A,T,C or G
aatcctgaacttcctgaagatgnccnagatgtgcagcttggnattccttcgacttctctncagccgagcttcccagaacatcacatatcactgcaaaaatagcattgcatacatnnatcaggccagtggaaangtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggcctgatcaagaattt

SEQ ID NO: 52393 - DNA, 309 bp, Homo sapiens
  misc_feature 6, 306, 307: n = A,T,C or G
atgtcnaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctnnct

SEQ ID NO: 52394 - DNA, 122 bp, Homo sapiens
  misc_feature 18, 68: n = A,T,C or G
accttccccatctgaaancttaaaaccactacctggagagcatacacgtgctgtgtctgtgcctgttntaaccacatgtatgtattactttaataaaaattcaaacattaaatatgtttcac

SEQ ID NO: 52395 - DNA, 254 bp, Homo sapiens
  misc_feature 16, 22: n = A,T,C or G
agagacggtgtttctnctggtnaggctggtcttgaactcccgatctcaggtgatccgccattaacacctgaagaggatccatgacagtgtttcttagatttctgtaccagcctttgtctgtattcgcacaaacttacaaatattccaggggaaaaattctatcttccctagtgtcttcaaataacatttatttaccttaaggatatacatacaaattattccctaataaacattactttctttaaactttttag

SEQ ID NO: 52396 - DNA, 440 bp, Homo sapiens
  misc_feature 6, 313: n = A,T,C or G
gggacncgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccgtgctgtgtctgttatgcnggcaaagccgaagatactatcaagtattctccctgatgacccccgacaaatgactctcttattctaaggatccttctacagatctgttataactatattggggtgggtttacaatacagcaagcctg

SEQ ID NO: 52397 - DNA, 394 bp, Homo sapiens
  misc_feature 120: n = A,T,C or G
attaacagctcactcgagcaagaaccctcctgacagtactggctagaagtttggatggattatttacaatataggaaagaaggccaagatttaggtaatgagtggatgagtaaatggtgntggatgggagtcaaaatcagaattatagaagaagtatttcctgtaactatagaaagaattatgtatatatacatgcagaaatatatatgtgtgtgtgtatctgtggatgggatatatgtatatctcttcctatatatatccatagtggcttattcagaacatagatatgtattcagcttgtcttcaaatacggccaagcagaaaatgttttatatttaataaatcatctttggctctgtatttaaatctatgatctgaaaataaaggcttctgg

SEQ ID NO: 52398 - DNA, 290 bp, Homo sapiens
  misc_feature 6, 180: n = A,T,C or G
gacatngggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggtnggttggctgattggtggaaagtagggtggaccaaaggaggccacggtgagcagtcagcaccagttctgcaccagcagcgcctccgtcctagtgggtgtcctgttctcctg

SEQ ID NO: 52399 - DNA, 206 bp, Homo sapiens
  misc_feature 4, 6, 48, 49: n = A,T,C or G
agtncngatgaactgaagcaagaagttatcagtaccagcagcaaggcnnaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctg

SEQ ID NO: 52400 - DNA, 132 bp, Homo sapiens
  misc_feature 39, 48, 71: n = A,T,C or G
ttgagtagaaaagtcgactatcgaggcaagagagctgancacggatgngaaactatagagcacaagtcttnccagaggagtttcttaatgagatatttgatttatttccagaccaataaattgtaactttgc

SEQ ID NO: 52401 - DNA, 439 bp, Homo sapiens
gaagcaagatggcggaggagcccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggctcagaacagttgtttatttatgtgaatcagtcctttgctccttccccagaccaagaagttggaactctctatgagtgtttggcagtgatggtaaactgggttttacattactggcaaggtctcaggcgtgggggatgaaccac

SEQ ID NO: 52402 - DNA, 455 bp, Homo sapiens
  misc_feature 5, 448, 452: n = A,T,C or G
ggcanctcatcaacaccagacctgtcctacaagaaatgctaaagtgatttctttagtttgaaagaaaaaaggcattaaggaaaaactaaaaaccatctaagggtagaaaactcactggtaatagtaagtacacagaaaaacagaatattatagcactataattgtgctaattatttatattttaagtagaaagacaaaaagatgaacttatcaaaaataactacaacaacttttcaagatatacacagcataataagataaagtagaaacaacaaaaagtttaaaagtgggatgacaaagttaaaatgtagcattttcattaattttctttttgtttatttgtttatgcaatcggagttaaattgtgatcagtttaaaataatggggttataaggtattatttgcaagcctcatagtaacctaaaaatcaaaaaagcatacaatgggntacncac

SEQ ID NO: 52403 - DNA, 464 bp, Homo sapiens
tcctctttgtccgacatcttgacgaggctgcggtgtctgctgctattctccgagcttcgcaaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccaggcagcccttcaggagctccttagtaaaggacttatcaaactggtttcaaagcacagagctcaagtaatttacaccagaaataccaagggtggagatgctccagctgctggtgaagatgcatgaataggtccaaccagctgacatttgg

SEQ ID NO: 52404 - DNA, 267 bp, Homo sapiens
  misc_feature 6, 8, 226, 252, 260: n = A,T,C or G
ctagcnanaaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaancccacattcagagttaaaacactggnttcaatgngttttta

SEQ ID NO: 52405 - DNA, 468 bp, Homo sapiens
  misc_feature 6, 49, 123, 419, 426: n = A,T,C or G
gaggcnttgaggcagccagcgcaggggcttctgctgagggggcaggcgnagcttgaggaaaccgcagataagtttttttctctttgaaagatagagattaatacaactacttaaaaaatatantcaataggttactaagatattgcttagcgttaagtttttaatgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaagattaaaatgaagggtgacttaaacagcttaaagtttagtttaaaaggtgnaggtgantaaaataattggaaggcgatcttttaaaaagagattaaaccg

SEQ ID NO: 52406 - DNA, 345 bp, Homo sapiens
gcttccccggcggtgacgacctacgcacacgagaacatgcctctcgcaaaggatctccttcatccctctccagaagaggagaagaggaaacacaagaagaaacgcctggtgcagagccccaattcccacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgaaa

SEQ ID NO: 52407 - DNA, 359 bp, Homo sapiens
  misc_feature 5, 61: n = A,T,C or G
agganccagggagagagcaagcagcgagtcttgaagctctgtttggtgctttggatccatntccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgcaggatgttgcttcagagtgtgaagtcaaatgcatgccaacattccagttttttaagaaggacaaaaggt

SEQ ID NO: 52408 - DNA, 121 bp, Homo sapiens
aaacaaaatgcccatggtggttctctgccctggacctgtgacattctggactatttctgtgtttatttgtggccgagtgtaacaaccatataataaatcacctcttccgctgttttagctg

SEQ ID NO: 52409 - DNA, 276 bp, Homo sapiens
  misc_feature 248: n = A,T,C or G
ggttctctcctttccagtcggagacctctgccgcaaacatgctccgcagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggatnacagcaagctgaagaaggaacgtccaga

SEQ ID NO: 52410 - DNA, 182 bp, Homo sapiens
gcagctagaacagtgtaggttccctcaataacccctttctgctgttctcccatgatccaactgtgtaatttctggcagtgattccaggttttaaataatttgtaagtgttcagtttctacacaactttatcatccgctaagaatttaaaaatcacattctctgttcagctggtaatgctgga

SEQ ID NO: 52411 - DNA, 167 bp, Homo sapiens
  misc_feature 136: n = A,T,C or G
gggcaagacctagtgctcctaagcctaaatgccttagaaatgtaaactgccatatataacagatacatttccctctttcttataatactctgttgtactatggaaaatcagctgctcagcaacctttcacctttgngtatttttcaataataaaaaatatccttgtc

SEQ ID NO: 52412 - DNA, 324 bp, Homo sapiens
  misc_feature 48, 53: n = A,T,C or G
taagatctgactgcctcctcctttctctggcctcttcccccttccctnttctnttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcaagactattaggaattgagaagggggatcaactaaataaacgaagagagctttccc

SEQ ID NO: 52413 - DNA, 362 bp, Homo sapiens
aagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagac

SEQ ID NO: 52414 - DNA, 135 bp, Homo sapiens
  misc_feature 6, 84: n = A,T,C or G
taaccncgagagttacttacaagaatgtgcctaactggcatagagatctggtacgagtgtgtgaaaacatccccattgtgttgngtggcaacaaagtggatattaaggacaggaaagtgaaggccgacttccatt

SEQ ID NO: 52415 - DNA, 381 bp, Homo sapiens
gaaagagaaggagagtaatctgggtgtaagacaactcaaagtttgctgagatgactttaatcttttgactctgttattaagatttttaccaaagagcaactgtagctatggtggcctgacttgaagggacagaccaaacaaacaacaaaacacaaaacaaaacaaacaaacaacaaaagcaagagcagaaactattggaaaatgatttattcaccaatattttaaaggttcttcctgttctaagcaaggaacatctttaagttctttataatgtacccattttacatttacaaaaactgccagaagttgcagcatgttttgggggtttctaagctatcagttaattttttggggacagttttattgataaactaacagagt

SEQ ID NO: 52416 - DNA, 414 bp, Homo sapiens
  misc_feature 6, 49: n = A,T,C or G
gaggcnttgaggcagccagcgcaggggcttctgctgagggggcaggcgnagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggtgacttaaacagcttaaagtttaagttaaaagtt

SEQ ID NO: 52417 - DNA, 180 bp, Homo sapiens
atgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccc

SEQ ID NO: 52418 - DNA, 356 bp, Homo sapiens
  misc_feature 6, 29, 219: n = A,T,C or G
ggggcnttgatgaagctgacagcattcgntccgatatgctcgatccgtgaccttagctgtgctcgcgctactctctctttctggcctggaggctatccagcgtactccaaagattcaggtttactcacgtcatccagcagagaatggaaagtcaaatttcctgaattgctatatgtctgggtttcatccatccgacattgaagttgacttactgaagantggagagagaattgaaaaagtggagcattcagacttgtctttcagcaaggactggtctttctatctcttgtactacacttgaattcacccccactgaaaaagatgagtatgcctgccgtgtgaaccatgtgactttg

SEQ ID NO: 52419 - DNA, 124 bp, Homo sapiens
  misc_feature 28, 61, 116: n = A,T,C or G
aatagagataagtccattttttaaaaangttttccccaaaccataaaaccctatacaagtngttctagtaacaatacatgagaaagatgtctatgtagctgaaaataaaatgacgncacacgac

SEQ ID NO: 52420 - DNA, 467 bp, Homo sapiens
  misc_feature 418: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttgnaggtgattaaaataatttgaaggcgatcttttaaaaagagattaacccc

SEQ ID NO: 52421 - DNA, 131 bp, Homo sapiens
gccctcagcgtgcaacatccaatgtgtttgctatgtttgaccagtcacagattcaggagttcaaagaggccttcaacatgattgatcagaacagagatggtttcatcgcaaggaagatttgcatgatatgc

SEQ ID NO: 52422 - DNA, 161 bp, Homo sapiens
  misc_feature 26: n = A,T,C or G
accttcagaaggaaaggagaatgttntgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 52423 - DNA, 240 bp, Homo sapiens
  misc_feature 44, 54: n = A,T,C or G
gcaaccaaattagaaatcaagattaagaaattcactcaaaaatnagttgagtgnggtggcacactcctgtagtcctagctactcggggctgaggcaggagaatcgcttgaacctgggaggcggaggttgcagtgagctgagattgtgccactgcactcctgcctgagtcacagagcgagactccatcttaaaaaacaaacaaaaaaaacaaaaacaaacaaaaaaaaccaaaaaaacaat

SEQ ID NO: 52424 - DNA, 334 bp, Homo sapiens
  misc_feature 20, 202: n = A,T,C or G
gacgacctacgcacactagnaacatgcctctcgcaaagggatctgcttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgcnccactgtcctctgccagcctacaggaggaaaagcaaggcttacagaaggatgttccttcaggaggaagcagcactaaaagcactctgagtcaagatgagtggggaaaccatctcaataaacacattttggat

SEQ ID NO: 52425 - DNA, 400 bp, Homo sapiens
  misc_feature 80, 151, 179, 370: n = A,T,C or G
gttggcaagttggccaaggctccccttattgctgatgtttattacattgttggtggcacgtccccccgggaggggatggncatcacgaggaacagagatggcccagcagacatttggcctctagatcctttgaatggagcgtggttccganttgagacaaattacgaccactggaagcnagcacccaaggaagatgaccggagaacatctgccatcaaggcccttaatgctacaggacaagcaaacctcagcctggaggcacttttccagattttgtcggtggttccagtttataacaaatgattttttaaaaaatgaaattcttgaagagctgcaccttaaaaaataagacaaagtgaaagtattgtanttatgttacaaacaatgcaggctccttcct

SEQ ID NO: 52426 - DNA, 244 bp, Homo sapiens
  misc_feature 69, 101, 145, 181: n = A,T,C or G
gcagtaaggaaacagcagcatctcgaccagcctctgccttaaaggaaatctttattaatcacgtgtggntcacagataattctttttttaaaaaaacccancctcctagagaagcacaactgtcaagagtggcttcagctttgcntcacgagtcttgtattccaagaaaatcaaagtggtncaatttgtttggttacactatgatactttctaaataaactctttttttttaccgcaaaaaaaa

SEQ ID NO: 52427 - DNA, 326 bp, Homo sapiens
  misc_feature 16, 17, 36, 37, 101, 112: n = A,T,C or G
ccaaacatataactgnnctcctcacacccaattggnnccgtctatcaccctatagaagaactaatgttagtataagtaacatgaaaacattctcctccgcntaagcctgcgncagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgaaaaaaaaaaaaaaaaaa

SEQ ID NO: 52428 - DNA, 310 bp, Homo sapiens
  misc_feature 57, 58, 106, 110, 149, 156, 174, 176, 205, 213, 235, 289: n = A,T,C or G
tgatcttcgttatttatgaaaaagacttttaaatgccctttctgcaggtggaagggnntctttatatactattcccaccatggggagcgaaaacgttaaaatcacnaggnattgcccaatctaagcagactttgcctttttttaaaggnggagcgngaataccagaaggatccngnattcagtcacttaaatgaagtcttttggncagaaatnacctttttgacacaagcctacngaatgctggggatatatttatatataaatatatctattttgagtgaaaccttgngaactctttaattagaggttt

SEQ ID NO: 52429 - DNA, 196 bp, Homo sapiens
  misc_feature 3, 5, 6, 12, 15, 23, 49, 59, 68, 70, 73, 80, 83, 86, 89,92, 103, 106, 108, 113, 122, 123, 126, 128, 131, 137, 138,140, 153, 155, 173, 189, 191, 194, 195: n = A,T,C or G
acncnnttttgngcnccgggganccccggtttttttcatggggcgcggnggttacaccnagataactnantgngttctcncgngtnttntanaagaaaaatanaananaaaanaaaggggcnnaangnaanataatnnanaaaagaaaaaagnanaaaaaaaataaagaaaanattaaaacgtttgcgngnggnng

SEQ ID NO: 52430 - DNA, 297 bp, Homo sapiens
ttatggaccgggctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggaaaaaaaaaaaaaaaaaa

SEQ ID NO: 52431 - DNA, 500 bp, Homo sapiens
  misc_feature 52, 308, 494: n = A,T,C or G
agcgagcctagcctccccgcgccctgggcagcgtggccctggagaatcaggngttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgaagtcaagtggngggagagacctcacaaagcaggaaaagcgaccactgtttttggctcctgactttgatcgttggctggatgaatctgatgcgggaaatggagctcaaagctaaggaagaagagcgcctaaataaactccgactggaaagcgaaggctctcctgaaactcttacaaacttaaggaaaggatacctggnttatgt

SEQ ID NO: 52432 - DNA, 400 bp, Homo sapiens
  misc_feature 6, 211, 270: n = A,T,C or G
aggagngaaggatataccagtcactatccacaatttagaggagtatctaagactgggtatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcnaagacactgatggaatgctgtaggcctgatcatggttatactcatgacagtcgggctgngaagtttttgtttgagattctcagtagttttgataatgagcagcagaggttatttctccagtttgtgactggtagcccaagattgccttgttggaggattccgggagtttgaatccacctttgacaattt

SEQ ID NO: 52433 - DNA, 490 bp, Homo sapiens
  misc_feature 33, 35, 384, 387: n = A,T,C or G
ggagcccagtattagcagaggtgctaaagggtnanaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatatttggaagctgtgtgtaagattgattcagcattccatgcacttgctttaaaatttagtcctgtgcatactgnggnggtttttactgtgcgtattttgaatttttcatgcagtttttctagagcaataatcagtggtgcctttgtacctaggttttatggtgattttaatgaaacatgg

SEQ ID NO: 52434 - DNA, 400 bp, Homo sapiens
gtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataa

SEQ ID NO: 52435 - DNA, 174 bp, Homo sapiens
aggaagaggaagatgggagaggccacaatttgactgaagaacagaaggcgatcaaggccaagtatccgccagtcaataggaagtacgagtatttggatcatacagcaggtgtccagttacacgcatggggagatactctggaggaagcatttgagcaatgtgcaatggccatgt

SEQ ID NO: 52436 - DNA, 370 bp, Homo sapiens
  misc_feature 327: n = A,T,C or G
gtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcggctaagactttttttcctgtggcttttatttatctaagaggnctttgcatatagatgaaatgtatattttgccctggcgggctat

SEQ ID NO: 52437 - DNA, 400 bp, Homo sapiens
  misc_feature 44, 206, 251: n = A,T,C or G
atggctatcatgactaagtgctagaatttatagttacaggcggngtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccntaagttaaaatctgaaggttatctttatcatgtttcatcccctgnctgaagatttcctagtcttcttatgtaaatcacatgactcatgtccgtaaatgaactatgaaagatatcgatcagtttatgatcattgacatgggatttcaaaaacacaggggtcttttaaaaatctttaatatgtcaaaatacaaggt

SEQ ID NO: 52438 - DNA, 279 bp, Homo sapiens
ccaaaggggaatgaactcagtttacatggcagctcattcacattcctccttttgaaggggtgtattttcttactggagatgaaaagaaaaaaaatctttatatcatgattccgccatgtgtacttccttctggaagaaattccatactatgatcaggcacttctttcagaagtcctatatttactcagaacatgctttctagcagtagtttgcagaagaaaaatgcaacttctacaattggaataaactgcctatagggaccccaaaaaaaaaaaaaaa

SEQ ID NO: 52439 - DNA, 145 bp, Homo sapiens
gcgtcgatgaagaacgcaggtagctgcgagaattaatgtgaattgcaggacacattgatcatcgacacttcgaacgcacttgcggccccgggttcctcccggggctacgcctgtctgagcgtcgcttgaaaaaaaaaaaaaaaaa

SEQ ID NO: 52440 - DNA, 410 bp, Homo sapiens
  misc_feature 201: n = A,T,C or G
ttggaaattataaccgcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcacttgtataaataggagaggntgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgaaacagtt

SEQ ID NO: 52441 - DNA, 156 bp, Homo sapiens
tagtgataccctatctcttaaaaaagaagaagtttttaaatttgaaataataataggtactggatttatgcaaatgtcttttctgcgtcttttgagatgagtatcaggtttttttttttccttttatcatctgaggaggaacttaaggtttccatt

SEQ ID NO: 52442 - DNA, 420 bp, Homo sapiens
  misc_feature 25, 174: n = A,T,C or G
gacttgggggataagaaggaaggtnaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcangagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattat

SEQ ID NO: 52443 - DNA, 460 bp, Homo sapiens
  misc_feature 213, 431: n = A,T,C or G
agtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagntacaggacatgattaatgaagtagatgctgatggtaatggcacaattgacttccctgaatttctgacaatgatggcaagaaaaatgaaagacacagacagtgaagaagaaattagagaagcattccgtgtgtttgataaaggatggcaatggctatattagtgctgcagaacttcgccatgtgatgacaaaccttggagagaagttaacagatgaagnaagttgatgaaatgatcagggaagcagat

SEQ ID NO: 52444 - DNA, 400 bp, Homo sapiens
  misc_feature 30, 51, 66, 90, 91, 142, 169, 209, 210, 257, 258, 316, 348,351, 376, 391: n = A,T,C or G
atgatgaaatgatgagatgagatgttgaantgaaatggtgagatgaactgntgaaatgaaatgaantaatgaaatgaaattgaaatacannttgaacatgagatgagatgaaatgatgagatgatgaaataaaatgatgaantgagatgtgatgagatgaaatgatganatgaaatgatgagatgagatgacatgaaataaatgaaatnntgaaatcgaaatgagatgagaagatacgagatgagatgaaatgatgnnatgaaatgatgaaatgagataagatgaaaagagttgatgagatgatgagatgaactgngatgaaaagagatgaaatgagatgaaatgaantgntgagatgaaatgaggtgaaatgaanttagatgaaacgtantgagatgaa

SEQ ID NO: 52445 - DNA, 400 bp, Homo sapiens
  misc_feature 23, 354, 376: n = A,T,C or G
agaaagtaaagagtaaaaatacnttcaatggtatttacttccaaggtaattcagttcaatcagtaatttgaattggtttcaactcttttttccttagggtaatgaggaaaaactattacatgggtacaaagttttaatgttcaggaaatattggccttgcccttaaggaaattatattggctgagatttctctcaaactagtttgtttagcattattaaaattaagtgacagtcacttggattaaatagcgataaaaagcatgagactttctagtgatttttgatgccaagcttcttatcactgttgggccttcacgtgtgtacttgaaaaaaaaaaaatatacaagccttgcnctggtttgaagattctagtagngaaagttacctaaccagttatcgg

SEQ ID NO: 52446 - DNA, 215 bp, Homo sapiens
atcactgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttt

SEQ ID NO: 52447 - DNA, 440 bp, Homo sapiens
ttaaactttaagtcggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagggggatgttacctccaggaaaatgcaggattaaaattgtccttg

SEQ ID NO: 52448 - DNA, 460 bp, Homo sapiens
  misc_feature 24: n = A,T,C or G
agaggaattcttagaaacaattantaagagcatatatggtaattgagactacagaatttaaaatggtctgtgtaagtctttattttctcgtaacatgacttgggtaccaattcaggctaatgactggtaaagaaaagaacagacactaatttgcaagtagctcctgaagttgattgctttaagaaaaaccttagcctttattttagctcttttagtaagtgaaattgtatatagatattttctaagtgaatttgatttccactagtgttttaattttataggataaatcttgttagccagtattttcctatgaaaatacctctgatgaaagtgaaaagtgtaccctcttcttaccattgaccctatgaccctatgaaagaatgttaattgagggccatgatacatgttaaaagagcagttaactcttcttgagaaagaaaaatttttaatggtcaattaa

SEQ ID NO: 52449 - DNA, 450 bp, Homo sapiens
  misc_feature 22, 354, 386, 432, 443: n = A,T,C or G
ctggcgagatgcgagtcacagncaggcatggagctgaggaacggggaagattttgccagtgaatcagaccttgtctctatgccatccactagcatccttaaggtgaggaaagaaccagcaggtctcagggtgaaccatggtatgtccactcagtggaacagtacgaaacagctaaacccaggttcgtaaagaaaatgtaggctggactggctgggggctgtggcccacacctgtaatctcggcactttgggaagctgagacgggcagatcacttgagatcaggagttcgagaccagcctggctgacacggcaaaaactctgtctctactaaaaacacaaaaattagctgggcgnggggcgtgcctacagtcccatctacttgagangctgaggcatgagaaaccttgaaccctaaaaggcaaaaggttgcangtgagccaagnatcattg

SEQ ID NO: 52450 - DNA, 350 bp, Homo sapiens
ccttctagaaaaaaactcgatgcacctatctggctcgaagatctagcttaaattaacacatcataatgatgaacttgaagtagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcaggtaacttgtgaaaattgaattcccatcaaactgaatgtaggcatttaatatctaaacatttaatgtggacttccaataaattcttttt

SEQ ID NO: 52451 - DNA, 500 bp, Homo sapiens
  misc_feature 30, 465: n = A,T,C or G
gggagcgagtttttccgtgctgtgtagggnctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgnaatagaacaatgataacatactataataaaagtta

SEQ ID NO: 52452 - DNA, 307 bp, Homo sapiens
attctagtagtaaaatatttttggcttaaaaactaaaaagaaataaggtgggggctgtggcgtgtgccatgcttataattccagctactcaggaggctgaggtgggaggattgtttgagcctaggagttcaagaccagcctgggcaacacagtaagaccctgtctcaaaacaaacaaaaactaaaaagaaacagcttaaattaaattgataatttatttgatctaacccaaaatattcaaaatattgtttcaacgtaaaatataaaaaagtaataaataagcaaaaaaaaaaaaaaaaaaaaaaaaa

SEQ ID NO: 52453 - DNA, 490 bp, Homo sapiens
cagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagtctacacattacatttgaagttaaacacaaaattatcagtgttttagaaacatgagtccggactgtgtaagtaaaagtacaaacattatttccaccataaagtatgtattgaaatcaagttggctctgtgtacagaatacatacttattcccatttttaagcatttgctttctgttttccctacctagaatggc

SEQ ID NO: 52454 - DNA, 462 bp, Homo sapiens
cgctggtgttaatttttacttatgagtgagccaagaactcaggccagagttgcggtaacaccaccagaagaggtctccgcttgtcagacttgagggatatcatcaatgagcctctgagctaatggtgtaaaccaaaaataaaattctaagccccccgccagccaaaccatctgaatggacttcctcctcagccagggcgctcttaaaatttaacctgagagactggttcaggtcatgatgggaagtaggggttggacatgcctcattatacctctccagcattaacatcaacataaaccctaagtctaagaaatttttacaacctattctctctgaagctgactaccttggaggcttcatctgtttcataaaattttggtctccacaacctcttacttcaacccagatatttcctttctattgatcccaggtctttagataaacttaaccaattgtcaaccc

SEQ ID NO: 52455 - DNA, 353 bp, Homo sapiens
gcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaa

SEQ ID NO: 52456 - DNA, 171 bp, Homo sapiens
gactaagagccttctgagcccagtcgacttctgaagggccccttgcaaagtaatagggcttctgcctaagcctctccctccagccaataggcagctttcttaactatcctaacaagccttggaccaaatggaaataaagctttttgatgcgaaaaaaaaaaaaaaaaaaaa

SEQ ID NO: 52457 - DNA, 175 bp, Homo sapiens
  misc_feature 22: n = A,T,C or G
ataatcacctaggtttacaaanactttttaggactcacgttaactcacatttatacagcagaaatgctattttgtatgctgttaagtttttctatctgtgtacttttttttaagggaaagattttaatattaaacctggtgcttctcactcaccaaaaaaaaaaaaaaaaaaaaa

SEQ ID NO: 52458 - DNA, 450 bp, Homo sapiens
agccgtagtcagggtttgtggcatttccacaggacatatgtacaggaaatggtggcattagtgtgacctgagggtggagtttttagccctctgatgtcaaaggctacccttcggagcacttgcacacgcccagttgaagggtgggtggtctcatcctgtttgaactggacaggagctagcccaaattcctgaaaaacaactgaagtaaccattaccagggtgacctatgaatgttatctgtaaagtaaccagtgaaggttaagtttcagcatgcagtggcgaggccttcagctaccgaggccttcagctaccacggccttcagcttcatgggaaaaggaaaaaaaataaaatataataacaaaaagcaagcgaccaaaagcaagcagtgcaggcagacctgatcagattaacccctctgtttcaaatatggggatacatttataaatcct

SEQ ID NO: 52459 - DNA, 220 bp, Homo sapiens
  misc_feature 11, 215: n = A,T,C or G
cccctattctnaggctacaccctagaccaaacctacgccaagatccatttcactatcatattcatcggcgtaaatctaactttcttcccacaacactttctcggcctatccggagtgccccgacgttactcggactaccccgatgcatacaccacatgaaacatcctatcatctgaaggctcattcatttctctaacagcagtaatattaataantttca

SEQ ID NO: 52460 - DNA, 134 bp, Homo sapiens
attcttcagcagaagagctgaggtagaagattaagagtgttgggggggcctgtgtcctggtggcttgaagccacatggagggagtttcattaaatgctaactactttttaaaaaaaaaaaaaaaaaaaaaaaaa

SEQ ID NO: 52461 - DNA, 297 bp, Homo sapiens
ttactactggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactgaaaaaaa

SEQ ID NO: 52462 - DNA, 420 bp, Homo sapiens
agctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttacctcaggcatttatg

SEQ ID NO: 52463 - DNA, 441 bp, Homo sapiens
  misc_feature 31: n = A,T,C or G
ttccctggaagagataggaatgagttctttntctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactaggttttgtcattccatttgttaaagatacagtcaccaagaatgttttgag

SEQ ID NO: 52464 - DNA, 416 bp, Homo sapiens
  misc_feature 20, 278, 291, 296, 304, 356: n = A,T,C or G
tctataaattaccgagagantagtttgtcctccacttagtgtgttagctggtggggtacaatataacctctcatctcaggctattttaaaaaaacaatatttgcttctattaacaaaaggaaacaaatctaagaatcattcctgtactacagaagggttaaggcaaaggtagccttttgggctttttaatgaatatgacccctatagaaaagtcaagaaaaaaaaaacccttggataaattattttatttattattggaattagatcttcacaaagtnggcttttcactgngtttnggcaacgngaaattaaattgtagttataagcaaaagttggttgcctagggaacaattgtntattcagtttaacagaaataaaagaatatttgtcttaagatgcaaaaaaaaaaaaaaaaa

SEQ ID NO: 52465 - DNA, 400 bp, Homo sapiens
  misc_feature 61, 73, 394: n = A,T,C or G
aaacagccttaagtatagcctaagaagagaattcctcttttcttctttagtccttctgccnttttttattttnagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgngaaata

SEQ ID NO: 52466 - DNA, 450 bp, Homo sapiens
  misc_feature 138: n = A,T,C or G
gaatctgacagcattcgggccgagatgtctcgctccgtggccttagctgtgctcgcgctactctctctttctggcctggaggctatccagcgtactccaaagattcaggtttactcacgtcatccagcagagaatggnaaagtcaaatttcctgaattgctttgtgtcctgggttccatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagaatgccgcatttggattgggatgaattccaaattctgcttgc

SEQ ID NO: 52467 - DNA, 259 bp, Homo sapiens
accctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatga

SEQ ID NO: 52468 - DNA, 300 bp, Homo sapiens
  misc_feature 75, 131, 164, 208, 232, 241, 255, 275, 285: n = A,T,C or G
catgaaatgagatgaactgaaaagcaaatgatgaaatgatattgaaatgaaattgaacagatgagatgatgagangaaatggtgaaatgttgaaatgaaatgatgaaatgaatagatgtgacatgaaatgngctgccatgatgagatcccatgaaatgaaatgngattaaatgatgagatgaaaactgatgaaaacttaaatgatganataatgaactgaaaatgaaatggnaatgatganatgagaagaaatgntgagatgagatgagataaantgagatgaantgatgagatgaactg

SEQ ID NO: 52469 - DNA, 380 bp, Homo sapiens
aactggaagaggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtttcagaactgtttgtttcaattggccatttaagtttagtagtaaaagactggttaatgataacaatgcatcgtaaaaccttcagaaggaaaggag

SEQ ID NO: 52470 - DNA, 190 bp, Homo sapiens
  misc_feature 15: n = A,T,C or G
aagactgaatacttncatcagaggtaaagacaaggatgttagctcttaaatctcttactcagcatagtgctggaagctctaccctgtgtaagagtcaagaagaaaaagtaaaagacacacaggttgaaatggaagtgaaattgtcttatttgctggttgtctgtgtgtaaatgctcaagaacctacagta

SEQ ID NO: 52471 - DNA, 132 bp, Homo sapiens
  misc_feature 50, 114: n = A,T,C or G
gcaacgtgttatgatgatgggaagacataccacgtcggagaacagtggcngaaggaatatctcggtgccatttgctcctgcacatgctttggaggccagcggggctggcgctgngacaactgccgcagacct

SEQ ID NO: 52472 - DNA, 280 bp, Homo sapiens
atattttaaatatccacagtactcactttttccgaatgatcctagtaattgcctagaaatatctttctcttacctgttatttatcaatttttcccagtatttttatacgaaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaaaaaaaaaaaaaaaa

SEQ ID NO: 52473 - DNA, 380 bp, Homo sapiens
  misc_feature 220, 370: n = A,T,C or G
cttcgacttctgtttttctcttccttcgctaacgcctcccggctctcgtcagcctcccgccggccgtctccttaacaccgaacaccatgccttcaattaagttgcagagttctgatggagagaaatttgaagttgatgtggaaattgccaaacaatctgtgactattaagaccatgttggaagatttgggaatggatgatgaaggagatgatgacccagntcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagntgaccaagga

SEQ ID NO: 52474 - DNA, 110 bp, Homo sapiens
  misc_feature 4, 7, 25, 41, 90: n = A,T,C or G
tttncangtattatccttttaagancattttaattttagtngagggcagggggcttttataccaaacgtgcagaaattttggggggctgngatttttccagtattaaaca

SEQ ID NO: 52475 - DNA, 220 bp, Homo sapiens
  misc_feature 112, 118, 208, 214: n = A,T,C or G
gctccgagcgtcggttgcccgacatgtgagtgccattccttggggcatttctgccactgcagccctcaggcctgctgcatgtggaagaacgagcttgacaaatttattgtgntctggntccagtcaagcaaaattattcagcaccagttcctcatgccatgcacctgctgtcacccagcatgcaccctattttaagggtacagcccgnttagtncaaatg

SEQ ID NO: 52476 - DNA, 460 bp, Homo sapiens
  misc_feature 393: n = A,T,C or G
ttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgnttgaatatcttcattcctctcaaattcataacagttctatttaactgaattaaataaccatatgaaa

SEQ ID NO: 52477 - DNA, 274 bp, Homo sapiens
cacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaatcaaaaaaaaaaaaaaaaaaaaaaaaaa

SEQ ID NO: 52478 - DNA, 132 bp, Homo sapiens
cagtagtgtacattaccatataatgtaaaaagatctacatacaaacaatgcaaccaactatccaagtgttataccaactaaaacccccaataaaccttgaacagtgaaaaaaaaaaaaaaaaaaaaaaaaaa

SEQ ID NO: 52479 - DNA, 450 bp, Homo sapiens
atgattcaacactgcattttacatccaacaaagtgaaatcttgatagttgggtgtaaaaaggagagtaatggagatttcagagtagttggggttgcttacttttcatttttaattctttaggtcttgtaagttacacacttcaagcattatagatgatcctctttttactactgaactaatgaagccttttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatggggttctgccttaaattgggaggactccaagccgggaaggaaaat

SEQ ID NO: 52480 - DNA, 390 bp, Homo sapiens
  misc_feature 193, 214: n = A,T,C or G
taccaaatcttacttcgaagagcttcggaagtagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggatgggcnccgggtggcttacgcctgtgntgctagaagtttgggaggccagggcgggcagattgcctgaggtcaggagttcgagaccagcctgggcaacacagtgaaaccccatctctactgaaaatacaaaagaatcagctgggcatggaagcgtgcgcccgtggtcccagctgcttgggaggctgagccaggagaattgcttg

SEQ ID NO: 52481 - DNA, 256 bp, Homo sapiens
aaacagtctaatacgtgttttcagatggccatgataaagaggttcttgagaagacaggcaaaaaacaacaacaacaacaacaaatcaagatcaaatgggaaaatatccaacctggcctcaatttctccgtggcaacattcactattagaagaaagttatggcaatgtctacaaagccttaaggaaagaaagcgtgacagaattgttcacgcttcaaactgtcattcaaaaaaaaaaaaaaaaaaaaaaaaaaaaaa

SEQ ID NO: 52482 - DNA, 440 bp, Homo sapiens
  misc_feature 34: n = A,T,C or G
gctggtggaaacgaaaacaaatttggatcacagnaaagaatgtgaaaaggtttgcgctcctgtgctcgccaaacccggagtcatcagtgtgatgggaacctaagcgtgggtggccaacatcatatacctcttgaagaagaaggagtcatgccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtggtttatgtgaacattcctatcaatccaaattcccttctggagtttcattgttatgcctgttgcaggccaaatgtaaag

SEQ ID NO: 52483 - DNA, 230 bp, Homo sapiens
tttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaaaaaaaaaaaaaaaaaaaaaa

SEQ ID NO: 52484 - DNA, 330 bp, Homo sapiens
  misc_feature 88, 100, 166, 169, 196, 212, 219, 252, 264, 269, 297: n = A,T,C or G
atcagaagcattgtgcatacagtttcattaactccttcccccgctcccccaaaaatttgaatttttttttcaacactcttacacctgntatggaaaatgncgacctttgtaagaaaaccaaaataaaaattgaaaaataaaaaccatgaacatttgcaccacttgnggnttttgaatatcttccacagagggaagnttaaaacccaaacttncaaaggnttaaactacctcaaaacactttcccatgagtgngatccacattgntaggngctgacctagacagagatgaactgaggnccttggtttgggtttggtcctaatacaaagggg

SEQ ID NO: 52485 - DNA, 307 bp, Homo sapiens
  misc_feature 209: n = A,T,C or G
tcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgancctgtgcttagcatgttagggtcattatacctcaggaatagcaagctgttaagtaaccatactgaattaactatttaattacagtgagctcatctctt

SEQ ID NO: 52486 - DNA, 131 bp, Homo sapiens
  misc_feature 5, 19: n = A,T,C or G
ccttngagatttgtaagcngtacatgatgcgagaactctcgaaaggagtgcgcatggaggtatggaactagacataaaggttctctaaatacttagacggcgtggatgagcctgaggcttgtctcatggag

SEQ ID NO: 52487 - DNA, 380 bp, Homo sapiens
  misc_feature 42, 263: n = A,T,C or G
agcaggaattcggtgtggacatagggccggtctgcttcttgnaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgncttcctgtaagaccttcgggtcaaggcagaggcaggaaactaactggtgtgagtcaaatgccccctgagtgactgcccccagcccaggccagaagacctcccttcaggtgccgggcg

SEQ ID NO: 52488 - DNA, 450 bp, Homo sapiens
atagaaaaacttacctaaaaatgtggttaaatatttgtttgattctgtgaagtaaaaaagttacattcactaggaattaatattttataataaagaatcatatggtgagataggctaaaagtgcctactgtttatttctttcttatgcttttgtttttatggatcaacttttctccaagtcattgcagagctaatattgcaacacctataaacagcgttcacaataataaaaaagtaactaccaatttgccacagcataggctcttgttttaaaggaaatgggttaagtaattttaaatagcataaaaagatagccatgtatcataactctttccaacatttctattccattggcttcaaatctttccagagaatgttcagacttgaagataacgaataaaattggcatattggctgggccccggtggctcatgcctgtagtcccagcat

SEQ ID NO: 52489 - DNA, 120 bp, Homo sapiens
  misc_feature 9, 49, 53, 68, 117: n = A,T,C or G
agaggagcnggcgacggtacagttagctggggcctttgaagatgatgangatntgacacttacaaggnggacaggcatgattattgggccaccaaggacaaattatgaaaacagatnttt

SEQ ID NO: 52490 - DNA, 260 bp, Homo sapiens
tgatttatagaattagtaaaaataagcataaataatacttcctggcttttctgttttctttagttattccaatggaaacagctggagaacttatatttccgtgagaaaaaatttgctgttgaagttcatgatccacgaaggtgaggatcaaagacgtttctctgtatgacacagttactatacaaataacgctgctatcaacatttgtgtacaagtttttatatgaacatatgttttcatttctcttgggtgtataccct

SEQ ID NO: 52491 - DNA, 317 bp, Homo sapiens
  misc_feature 44: n = A,T,C or G
ctaaatgaatattatccctaatacctgccaccccactcttaatngtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaaaaaaaaaaaaaaaaaaaaaaaa

SEQ ID NO: 52492 - DNA, 327 bp, Homo sapiens
  misc_feature 211: n = A,T,C or G
tataggctctgcccagaatgccatcacatccctgatactgtgtatgctttgaagcacccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcntgtgaacaccatcatgcctttataaaggatccttattacaggaaaagcatgagtggtggctaacctgaccaataaagttatttttatgattgcaaaaaaaaaaaaaaaaaaaaaaa

SEQ ID NO: 52493 - DNA, 470 bp, Homo sapiens
  misc_feature 70, 237, 422, 435: n = A,T,C or G
agtccgagtggagcagagcgagctgagtggttgtgtggtcgcgtctcggaaaaccggtagcgcttgcagnatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatggttaatgaagnagatgctgatggtaatggcacaattgacttccctgaatttctgacatgatggcaagaaaaatgaaagacacagacagtgaagaagaaattagagaagcattccgtgtgtttgataaaggatggcaatggctatattagtgctgcagaacttcgccatgtgaatgacaaaccttggaggagaaagntaacagatgaagnaagttgatgaaatgatcagggaagcagattttgat

SEQ ID NO: 52494 - DNA, 410 bp, Homo sapiens
ggatcctctttgcatttgtaaagctttggagatattgaatcatgttaccatttctgtttttttccaccctgttttcttccatatttactgaagctcagaagcagtattgggtctgcaactcatccgacgcaagtatttcatacacctactgtgataaaatgcaatacccaatttcaattaatgttaacccctgtatagaattgaaaggatccaaagggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactggtgaatacaacaatatcattctccttcaagg

SEQ ID NO: 52495 - DNA, 222 bp, Homo sapiens
  misc_feature 3, 28, 29, 163, 217: n = A,T,C or G
gancattgctccctctggctatcatgcnnactactgcgagggtgagtgcccgagccatatagcaggcacgtccgggtcctcactgtccttccactcaacagtcatcaaccactaccgcatgcggggccatagcccctttgccaacctcaaatcgtgctgtgtncccaccaagctgagacccatgtccatgttgactatgaatgatggtcaaaacatncattc

SEQ ID NO: 52496 - DNA, 378 bp, Homo sapiens
ataacaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgc

SEQ ID NO: 52497 - DNA, 260 bp, Homo sapiens
gcgacaaacctaccgagtcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaaaaa

SEQ ID NO: 52498 - DNA, 330 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaaggatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacaga

SEQ ID NO: 52499 - DNA, 296 bp, Homo sapiens
agcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgcccgggggtcccacagcatcctgtgagcatttccgcggggaagctgagcacgtgaagctcgctggttctgtgcgaagggcattcctggtgctgaataaaagggtgttgcttgtcaaggcaaaaaaaaaaaaaaaaaaaa

SEQ ID NO: 52500 - DNA, 343 bp, Homo sapiens
  misc_feature 285: n = A,T,C or G
ccggttaccgacaccaaataattaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggnttgactatttctgtatgtctccatctattgatgagggtcttaaaaaaaaaaaaaaaaa

SEQ ID NO: 52501 - DNA, 510 bp, Homo sapiens
  misc_feature 12: n = A,T,C or G
cttttcacaagnatggcgccgaaagcgaagaaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgccgaccactgagtctgccatgaagaagatagaagacaacaacacacttgtgttcatttgtgggatgttaaagccaacaagcaccagattaaacaggctgtgaagaagctgtatgacatttgatgtggccaaggtcaacaccctgattcggcctgatggagagaagaaggcatatgttcgactggctcctgattacgatgctttggatgttgccaacaaaattgggatcatctaaactgagtccagctgcctaattct

SEQ ID NO: 52502 - DNA, 200 bp, Homo sapiens
tatattgtgttgatgacgtacgttatttccatggaagatagccgctgtggcagctgtcacatcaccacagctccctagggtctgccgagaaggcaggcagtctttgggttctgttctttgtcacgtccccctacaagtaaattttgtttctttgaacgtttattaaaatgccaagacccaaccaaaaaaaaaaaaaaaaa

SEQ ID NO: 52503 - DNA, 400 bp, Homo sapiens
  misc_feature 96, 327: n = A,T,C or G
attattcacaaaatatttatgatgtatttactctgcaccaggtcccatgccaagcactggggacacagttatggcaatagtagacaaagcatttgntcatttggagcttagagtccaggaggaatacattagataatgacacaatcaaatataaattgcaatgatgtcacaggtgtgatgaagggagagtaggagagaccatgagtatgtgtaacaggaggacacagcattatttctagtgctgtactgttccgtacggcagccactacccacatgtaactttttaagatttaaatttaaatttagttaacattcaaaacgcagctncccaatcacactagcaacatttccaagtgcttgagagccatgcatgattaagtgggttaccctattgaatagg

SEQ ID NO: 52504 - DNA, 525 bp, Homo sapiens
  misc_feature 211: n = A,T,C or G
attgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctacctggagcaacactgtatctcttgcgtctggcattgttcaatccagatgtttgntgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattgggagattacaatgattaaatcaataaataactgaaacttgaaaaaaaaaaaaaaaaaaaa

SEQ ID NO: 52505 - DNA, 310 bp, Homo sapiens
  misc_feature 268: n = A,T,C or G
aagaaaaggcttattgttcctcgagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccgggctaaccagtgaaccccaaccccagaagagaaggctgtggctgctagtgacctctttgctgtggcccctcatttgacctttcacctctgtctgttgnaagcagtactttttactgcctcattgtcttctgtacatctta

SEQ ID NO: 52506 - DNA, 180 bp, Homo sapiens
  misc_feature 8, 19, 74, 91, 112, 142: n = A,T,C or G
catcaccnaactgtgcacnaaaatgcaactgccctgtaagctacccaagtgccatgtactgtgatgagctgaanttgaaaagtgtaccaanggagcctcctggaatcaagtntctttaccttaggaataaccagattgaccntattgatgaaaaggcctttgagaatgtaactgatctgc

SEQ ID NO: 52507 - DNA, 350 bp, Homo sapiens
atatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattttatagtttgaaaagcactttgcacacagttcttgtatataaaagtaaagatgtaattataggatattagtggttcctgctttgtttaataagaacctcatttaaacttgacagctatggtatttttttaatgataacttc

SEQ ID NO: 52508 - DNA, 400 bp, Homo sapiens
  misc_feature 256: n = A,T,C or G
ttgagtatgaatgcaagcccaacgagtacacgcagtctgatgtgggtgaacaaggagtccttcctctgaaagtggctctttctgatgctactggacaatcttttcagaaatctacttttagataaaccagcgcaggccttaaacaaggcatgccacaccattgctgttccccatctggtactaatgacctactagccctggttattttgaaagtgtaattcccctctgacacaatatccctcacatacaagatggngatgtaccactcccgagaatattcccatctgtattttgtgctgatgttcctgcatccagttgttctcggtcatacttttgaccacttggactggagttcagtggcccctggcaggcttgtcctgctcttgaccatccccactga

SEQ ID NO: 52509 - DNA, 463 bp, Homo sapiens
cgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttatttgagggcaagaaggctgcccaaagacacgagactttaacaagcttgaactttaaaaaaaaaaaaaa

SEQ ID NO: 52510 - DNA, 230 bp, Homo sapiens
  misc_feature 191: n = A,T,C or G
ggaagtgtaggttacggtctgagacatcaccgccaagctgggcatcggggagatggccgagactgaccccaagaccgtgcaggacctcacctcggtgggtgcagacactcctgcagcagatgcaagataaatttcagaccatgtctgaccagatcattgggagaattgatgatattgagtagtcgcattgntgatctggaaaagaatatcgcggacctcatgacacaggc

SEQ ID NO: 52511 - DNA, 400 bp, Homo sapiens
  misc_feature 61: n = A,T,C or G
aggcattgaggcagccagcgcaggggcttctgctgagggggcaggcggagcttgaggaaancggcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaag

SEQ ID NO: 52512 - DNA, 420 bp, Homo sapiens
ctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatga

SEQ ID NO: 52513 - DNA, 400 bp, Homo sapiens
  misc_feature 391: n = A,T,C or G
ataataaataaacttcacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaattttattacgttgataaaacttataaatttcattgattaatctcctggaagattgtttttaaaaagaaaagtgtaatgcaagaatttaaagaaatatttttaaagccacaattattttaatattggatatcaactgcttgtaaaggtgctcctcttttttcttgtcattgctggncaaggatta

SEQ ID NO: 52514 - DNA, 239 bp, Homo sapiens
ttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaaaaaaaaaaaaaaaaaaaaa

SEQ ID NO: 52515 - DNA, 467 bp, Homo sapiens
tccttttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcacccgtttggctcgatattataaagaccaagcgagtcctccctcccaattggaaaaaaaaaaaaaaaaaaaa

SEQ ID NO: 52516 - DNA, 440 bp, Homo sapiens
  misc_feature 22: n = A,T,C or G
attatgaactgattgaccaagnagctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtcccctgtactattatatccagcaagacactaagggcgactaccagaaagcgctgctgta

SEQ ID NO: 52517 - DNA, 215 bp, Homo sapiens
  misc_feature 9: n = A,T,C or G
taaaaatcntaattagagcgagaagaggagacccatccctaacttgccagatgatcagtcaggctcatgaaccattgatatcttcctgctattgatgaatgtgacttcagccattctagcgccattactgtggaacgtgattggcagaaagccgcgcgtccgcaccaaaacacctttttatacaaatgacagatgcgtgaattaaagagattaaa

SEQ ID NO: 52518 - DNA, 205 bp, Homo sapiens
  misc_feature 17, 24: n = A,T,C or G
agaaatggcatccttanaagctangagttgaaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaagaaacataaaaaaaaaaaaaaaaaaaaaaa

SEQ ID NO: 52519 - DNA, 113 bp, Homo sapiens
agcggcttcttcttgggtagcaagggtggtgtgaatagcggcagcgaggggctcggaagaaggtgctcggattctcgtagctgtgccgggacttaaccaccaccatgtcgagc

SEQ ID NO: 52520 - DNA, 165 bp, Homo sapiens
ctctaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgc

SEQ ID NO: 52521 - DNA, 376 bp, Homo sapiens
  misc_feature 21: n = A,T,C or G
cttttttttctgggctcggancctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaattttatgtagc

SEQ ID NO: 52522 - DNA, 370 bp, Homo sapiens
  misc_feature 44: n = A,T,C or G
tttctcttccttgcttaaaaagagttgcttttaacctcatcccntggattttggtggggaaaagggtacaacttcctgatttgctgtttcactttgaaacaacacaatttgttagatacttagggagatatactgttgaatttgcacaggatgtgactctgtttatacatattaacaaatttccttttggattcctttagcagttcatcaaattagtattaaatttttaaatttaaaactagcatgaagggacatgaaatattttgcagtaggtggatctatgtaagatgtttggggtatggcattaatagcttgacaaagatttggggaaaaggtggtaagaaatgagtccatctcagcccaatagtgc

SEQ ID NO: 52523 - DNA, 300 bp, Homo sapiens
  misc_feature 299: n = A,T,C or G
gatcaataggaaagcatatgccagccaaccaagatgcaaatgttttgaaatgatatgaccaaaattttaagtaggaaagtcacccaaacacttctgctttcacttaagtgtctggcccgcaatactgtaggaacaagcatggtcttgttactgtgatattttaaatatccacagtactcacttttttccaaatgatcctagtaattgcctagaaatatctttctcttacctgttatttatcaatttttcccagtatttttatacggaaaaaattgtattgaaaacacttagtatgcagnt

SEQ ID NO: 52524 - DNA, 300 bp, Homo sapiens
  misc_feature 14, 35, 36, 52, 67, 68: n = A,T,C or G
tgagaagtttgacnctaaagagccttctgcaagannccctggggccatttantcctacctccaaganncaagcattttgcgtttggatggcaatcgcatctcagaaacccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacttccatgaattttaaaatctgagggaaatgttttgtaaacatt

SEQ ID NO: 52525 - DNA, 340 bp, Homo sapiens
  misc_feature 18: n = A,T,C or G
agcctgtgtcctgcagancaatggtggcttgcattctgtaagtggctttcagaggccagcagcccctggggaaattgatgggtgtggcagtggaccctgtgaagagggagaatctagcccttcagccctgtccagtgttaacccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttc

SEQ ID NO: 52526 - DNA, 289 bp, Homo sapiens
  misc_feature 79: n = A,T,C or G
tgagaaaccctgagggaaattgtggagttagccctccctgtggtaaaggaattgaagaaaatataacaccttacacccntttttcatcttgacatttaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcctt

SEQ ID NO: 52527 - DNA, 260 bp, Homo sapiens
  misc_feature 58, 78: n = A,T,C or G
cgtggtattgcctttttgccttgaaatttagttcctgataaaggtggaaatgttttantcttctcttttgtggaaaancagataatgggagttggggcaggaaagccctattggcccattccttccaaagaccagaccagaatcaccctggaggccgttcaaaagatataacccaaataaaccaagtcatcccacaatcaatacaacatttcaatactttcccaggtgtgtcagacttgggatgggacgctgatataata

SEQ ID NO: 52528 - DNA, 389 bp, Homo sapiens
aatgtttctcaatcttgttaaaagctcaaaattttgggccctactttgtaatgccagtgtgacacttaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagttttgtagtcatgagacttaaagtggaaataagactatttttgacaaaagatgccattaaatttcagactgtagagccacatttacaatacctcaggctaattact

SEQ ID NO: 52529 - DNA, 132 bp, Homo sapiens
  misc_feature 17, 24: n = A,T,C or G
ttctctgttggtcggantcggccnagttgccctgaagtagggaagctgagtgtgtcgctccctggtccactgtttctcctataaatgtaaatgggtcacgctcaaaaaaaaaaaaaaaaaaaaaaaaaaaaa

SEQ ID NO: 52530 - DNA, 310 bp, Homo sapiens
  misc_feature 24: n = A,T,C or G
gcagtttcctcaaagaaccaaacnctccttgcaaatgggtgtgaccgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcatttaaggttccagtta

SEQ ID NO: 52531 - DNA, 410 bp, Homo sapiens
taccagtgatgtgtcccttcttcttgaccccacttacatttacccaccatttaacatacatttcgtgtggaccaaaataaactaaaagaaccaataagctcatacattcttctttctgctttcccttcatataccccacttatttattatgggtgaacaacgaagcactaatggtcaaacaatacaactaaagacacaagttttcagggagatttccagatgatgatgatgaaagtgaagatcacgatgatcctgacaatgctcatgagagcccagaacaagaaggagcagaagggcactttgaccttcattattatgaaaatcaagaatagcaagaaactttataggtatacacttacgacttcacaaaacctatacttaatatagtaatctaagtaaacattgtatta

SEQ ID NO: 52532 - DNA, 223 bp, Homo sapiens
gagagttatttgtttagtaggtaccagagttaccagttttgcaagatgaaaaagttctggaaatggatggttgtgattggtgcacaacaatgtaaatgtacttaatgtcactgaactgtacacttaaaaatggttaaggcggttctttttttgttatatgtattttaactttaaaaataatacttttaaaatgtgagaaaaaaaaaaaaaaaaaaaaaaaaaa

SEQ ID NO: 52533 - DNA, 198 bp, Homo sapiens
  misc_feature 8, 23, 36, 69: n = A,T,C or G
gccaaaantcctggaatgggttnctaaataagtganttgttggcaccctccctactgccaatactctcntaaaattgaaataatggtacccagattaaaattactagatgggaaatgaagcttgtgtatcccatttattcatgtgtaatcaataaacgatttaattctctggaaaaaaaaaaaaaaaaaaaaaaaaaa

SEQ ID NO: 52534 - DNA, 166 bp, Homo sapiens
acttaaaaaatatcacaaagttgccagatgctatggctcatacctgcagttccagcactttgggaggctgaggcaggaggattgcttgagtctgggagtttgagaccagcctagacaacatggtgagatatcacctctacaaaaaaaaaaaaaaaaaaaaaaaaaa

SEQ ID NO: 52535 - DNA, 220 bp, Homo sapiens
  misc_feature 163: n = A,T,C or G
aaacatacatttattcatgccagtctgttgcatgcaggctttttggcttcctaccttgcaacaaaataattgcaccaactccttagtgccgattccgcccacagagagtcctggagccacagtcttttttgctttgcattgggggagagggactaagtgctanagactatgtcgctttcctgagctaccgagagcgctcgtgaactggaatcaactgctt

SEQ ID NO: 52536 - DNA, 340 bp, Homo sapiens
ggtcttccccgcagtgaaagtggaccatgttgaaaaattaggtctgaattcaagaagaaagtaccggcaagtccctgtactattatatccagcaagacactaagggcgactacccagaaagcgctgctgtaccctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcatttttagttgcctaagcattgcctggccttcctgtctagtctctcctgtaag

SEQ ID NO: 52537 - DNA, 400 bp, Homo sapiens
  misc_feature 24: n = A,T,C or G
ttagtagaggcagggtttcacccntattagcccggctggtcttgaactcctgaccctcaagtgatctaccaacctcagcctcccaaagtgctgggattacaggtgtgagccactgtgcccagcctaaacagcatacttttaaacaaccaatgggtcaaaaaataagtcttagaaattaatgaaaacaaaacgcaacctgccaaaacctatgggacacagtgaaagttgtgctaagattaaaaattatagctataaatgcttacattaaaaaaaagaaatatctcaaatcagcaacttcattttacaacttaaggagctaaaaaagaatacagtagacccaagctagccagaacaaaggaaacagtaaacatggataaatgaaaaaaaaaaaaaaaaaaaa

SEQ ID NO: 52538 - DNA, 390 bp, Homo sapiens
  misc_feature 32, 33, 43, 353: n = A,T,C or G
atgaaaagcagaagagttcctttttctaagannctgtttttcnttagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatggagaagatctgttattacattaggattattacgttantttattatgatccctagttgatggcctaaataaacac

SEQ ID NO: 52539 - DNA, 120 bp, Homo sapiens
  misc_feature 23, 28, 70, 78, 79: n = A,T,C or G
aattgtgaaagcaaaggaaggantaatntaccctgactaaagcttgaaatgctacatttccctggtgaanatgcgtgnncacatgttttggcatgattgaaaaggatctcattccatggg

SEQ ID NO: 52540 - DNA, 460 bp, Homo sapiens
aaaaataaaaacctaaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaaatttgatttagcattcatattttccatcttattcccaattaaaagtatgcagattatttgcccaaagttgtcctcttcttcagattcagcatttgttctttgccagtctcattttcatcttcttccatgggtccacagaagctttgtttcttgggca

SEQ ID NO: 52541 - DNA, 400 bp, Homo sapiens
cctgttagacatgactgatgacctattctgaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttggtttgc

SEQ ID NO: 52542 - DNA, 320 bp, Homo sapiens
  misc_feature 5, 284: n = A,T,C or G
gaccnactgatgggtcaccaacttgcctgtaatacttaggttctcacctttttagcttcgaaactgtgtccactgcaaagactctacaactgttaagacttgtgtggttgaattttgacttcttttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggntaattatttacctctatttcacaaatgagataatgg

SEQ ID NO: 52543 - DNA, 147 bp, Homo sapiens
  misc_feature 28, 40: n = A,T,C or G
aaaccacttttgtacttgatgtagcccntgaggtagttcntgaaaaatgctgtgcacttcatttccctggaataaatgttggaaagctgatctttttcttgatataaaaatgttgaatgagaaaaaaaaaaaaaaaaaaaaaaaaaa

SEQ ID NO: 52544 - DNA, 223 bp, Homo sapiens
  misc_feature 26, 33, 49, 57, 110, 149: n = A,T,C or G
aatgtctctctggaccctgttaactnaaaagantttgctttcctcaganggaagttnttttcttttcctcaaccctgataccaaaatcagccaaaggcatttattaaganaggaaaataaaaaagaaaaaaatacagataaatatcccnttttacttgacataaaattataaaaaaattagcaaattgaatgcaaaaaaaaaaaaaaaaaaaaaaaaaaaaaa

SEQ ID NO: 52545 - DNA, 330 bp, Homo sapiens
cttctacttaccttggatttaatttgctcttttgttttagtttcctaaggtggacacttaaatgattaatttcagatttttttgctaatatattcattcagtgctatacatttccctctaaacactgcttttgctatatctcacaaattttgataggttgtatttttcatttgttttccaaagctaaacacaggcttaccatatgatccctcacttacactcatgtatttacccaaatgagttaacaatttatgttcacccaaaaacctgcacacaaatggttacaacagccaaaaattaattacccaaaaaaaaaaaaaaaaaaaaaaa

SEQ ID NO: 52546 - DNA, 400 bp, Homo sapiens
  misc_feature 14, 23, 88, 97, 185: n = A,T,C or G
gccgtttggcctcntctcgtgcnctagtactaggcacctacacctacacagtctcagcaaggttctaaagaaccctgtcaggtccacnttgcaacantggccttgctactttggattagctcctttaagcctgaaaataactttcctggtcatggaagaactggacgcatcttttaacttatganataggaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtatta

SEQ ID NO: 52547 - DNA, 510 bp, Homo sapiens
  misc_feature 35, 492: n = A,T,C or G
catttcctgaagctgacagcatttcgggccgagangtctcgcttccgtggccttagcttgtgctcgcgctacttctctctttctggcctggaggctatccagcgtactccaaagattcaggtttacctcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatgggaggtttggaagatgccgcatttggatttggatgaattccaaattctgcttgcttgctttttaatattgatatgcttatacncctttacacctttatgca

SEQ ID NO: 52548 - DNA, 270 bp, Homo sapiens
attattgggaatgtaaattattatagtcagtatggaaaacagtatggaagttcctcaaaaaaagcaaaaataaaactaccacatggtccagctatctcactgctgggtgtatattcaaaagaaaggaaatcaatatatcaaagatgtatttgaacttctgtgtttattgcagcactattcacaatagtcaagatatggaatcaatctaagtgtccatcaacagatgaatgaataaataaaatatagtacttatacataataagagtatta

SEQ ID NO: 52549 - DNA, 500 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaa

SEQ ID NO: 52550 - DNA, 440 bp, Homo sapiens
  misc_feature 10, 19, 105: n = A,T,C or G
gaaacatgcntaagtgccnatcctttgaatgttccacggaaacactggtggacagattctagtgctgagaagaaacacgtttggtttggagagtccatggatggnggttttcagtttagctacggcaatccctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactaccctattgtagatattgca

SEQ ID NO: 52551 - DNA, 510 bp, Homo sapiens
  misc_feature 14: n = A,T,C or G
actctgcgcttganatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttg

SEQ ID NO: 52552 - DNA, 400 bp, Homo sapiens
  misc_feature 207, 208, 210, 325, 345, 395: n = A,T,C or G
agaaattaaccctccaaagtttgaatgctcttttatgacttagtgtcaatatttaacttacctgaagcttgacttcatgcaagtgttggatgaatttctttataaagattgcagaggatagtgatgaaaacttgaattagtatctttagagttatgtttgaaatattttatgaacgttgattttattaagtggcagcctttcgtggnngnatgaactgatgtgcctttaagtgtttttttcatcaacagaggaattctaataatatctgttatgctgcagaaaacttagcaaatggacctacattctgacattcagtcaacaagngaatgattaagcatagctgntacaagttaacagactacatctcttacctctgactattgtactgaaagtncatgt

SEQ ID NO: 52553 - DNA, 162 bp, Homo sapiens
  misc_feature 4: n = A,T,C or G
atcnttgaacatattaatggttatttctttttcttggatttccagaaaagcctcttaattttatgctttctcatcgaagtaatgtaccctttttttctgaaactgaattaaatactcattttatctttgaaaaaaaaaaaaaaaaaaaaaaaaaaaaaaaaa

SEQ ID NO: 52554 - DNA, 400 bp, Homo sapiens
  misc_feature 83, 211, 285, 346: n = A,T,C or G
ttttttcttttttccggcgttcaagtatgtcgaagcgaggacgtggtgggtcctctggtgcgaaattccggatttccttgggncttccggtaggagctgtaatcaattgtgctgacaacacaggagccaaaaacctgtatatcatctccgtgaaggggatcaagggacggctgaacagacttcccgctgctggtgtgggtgacatgggganggccacagtcaagaaaggcaaaccagagctcagaaaaaaggtacatccagcagtggtcattcgacaacgaaagncataccgtagaaaagatggcgtgtttctttatttttgaagataatgcagggagtcattagngaacaataaaggccgagatgaaagggttcttgccattacaggaccagtagcaaa

SEQ ID NO: 52555 - DNA, 210 bp, Homo sapiens
  misc_feature 2, 6, 13, 208: n = A,T,C or G
anatanccgcagnagtgtatataggttatatttaaatactgagtgccagtttatatcagggacttgaacatccatggattttggtattttgtaggggagtgttctagaaccagtaccccacagataccaagggatgacagtactagtgaaaacaaacaacatcaaaattttttgaattctaagatactatttgattggggagataagnca

SEQ ID NO: 52556 - DNA, 400 bp, Homo sapiens
  misc_feature 56, 57, 286, 366: n = A,T,C or G
taaaggtctattcatgaagatgaagatgaaaatattgaaatttgttcaaaaatagnncaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcntgaaaaagatggagaaacatgccatttttcaatgaagattctaatattttatctatttttgttcattgaattccatgggntaaatctcataaaatatatacctttattaaatca

SEQ ID NO: 52557 - DNA, 500 bp, Homo sapiens
  misc_feature 55, 56, 84, 430, 492: n = A,T,C or G
ccttaaatgcatatacagtattagagtcaaaaactattttatccctctttgctgnntttcccccttctgcccactttcctgggngttgggggggcccgctgacaacagtcacaaatccagcgacctaggaaaaaaaattgttaatataggaatgaaaaattatctttacaggactgaattttaagcccatctaaactcttctgccttagctatcactaatgatattcctctctggattttgtggtgagaagggcactatgagttccttaatttaaggaaaaaaatgtaaacttaatcaatgtaatcaatgccatgcaaaattcattgcaagtcaagggggatgggagagatgcaatgccatacggtgatacggacctttaagaaagtacaatctttcctgaaattcaaacactatcatacttcaaaaggncaaaacccattccggaatttggcttttttaagactttttctctcctgctcactggcagctgngtgtctta

SEQ ID NO: 52558 - DNA, 460 bp, Homo sapiens
  misc_feature 213: n = A,T,C or G
atagcggcagcgaggggctcggcaaagtgctcggattctcgtagcctgtgccgggacttaaccaccaccatgtcgagcaaaagaacaaagcaccaagtaccaagtaagcgccctcagcgtgcaacatccaatgtgtttgctatgtttgaccagtcacagattcaggagttcaaagaggccttcaacatgattgatcagaacagagatgggtgnatcgacaaggaagatttgcatgatatgcttgcttcattggggaagaatccaactgatgagtatctagatgccatgatgaatgaggctccaagccccatcaatttcaccatgttcctcaccatgtttggtgagaagttaaatggcacagatcctgaagatgtcatcagaaatgcctttgcttgcctttgatgaagaagcaactggcaccatacagggaagattacttgagagagctgcttgacaaccc

SEQ ID NO: 52559 - DNA, 140 bp, Homo sapiens
  misc_feature 56, 96: n = A,T,C or G
taaggagcctctctccctactgctgctacacaagaccctgagactgacctgcaggncgaaaccatgaagagcctgatccttcttgccattcctggncgccttagcggtagtaactttgtgttatgaatcacatggaaaag

SEQ ID NO: 52560 - DNA, 410 bp, Homo sapiens
  misc_feature 14: n = A,T,C or G
agtcaaacactggnatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtgggttgtagctgatgaggttattaccctcatagagactataatattctatttgggatata

SEQ ID NO: 52561 - DNA, 510 bp, Homo sapiens
aaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtatttttttgtatttgagaagataatgcttttgctttactgagacattatttacttgactatttttgggtcaatactactactgttgtcaccatttatgattctgaattttaaaggtgggaaagttctaagtatcaaag

SEQ ID NO: 52562 - DNA, 360 bp, Homo sapiens
  misc_feature 99, 303: n = A,T,C or G
aaatgaacagacttggtttccttgctttcttgacatttccatgactgtttcacatacaaactattgggtgaggtttttcagctgttaccgacccacgtnctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgngaacagcattagaactttggctatttcttaattttaaaatatgctgatatgccttaa

SEQ ID NO: 52563 - DNA, 203 bp, Homo sapiens
tgatcccagcaagaaatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaaaaaaaaaaaaaaaaaaaaaa

SEQ ID NO: 52564 - DNA, 520 bp, Homo sapiens
  misc_feature 12, 29, 470: n = A,T,C or G
gccattgaggtngccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggngattaaaagaccttgaaatccatgacgcaggggagaattgcgtcatttta

SEQ ID NO: 52565 - DNA, 356 bp, Homo sapiens
  misc_feature 7, 333: n = A,T,C or G
ggacatncggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaaccctttgtaagaaancccaaaaaaaaaaaaaaaaaaaa

SEQ ID NO: 52566 - DNA, 262 bp, Homo sapiens
cgggcctgactgcacgcaagtgtcctgggggcttctccaacccctgctatggcaaaaggcaatgtgagtcccatcctctcctggggtgaggtatggggaacacaaggactccttcaccggttggccagtgactggctgtgtgtctgggccaagcctgccactctggccttgggattctcatatctatgcaggggaaagttggatcaaattatttctcatattttaattaaaaataattaggagagaaaaaaaaaaaaaaaaa

SEQ ID NO: 52567 - DNA, 230 bp, Homo sapiens
agctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcctaaaaaaaaaaaaaaaaaaaaaaaaa

SEQ ID NO: 52568 - DNA, 367 bp, Homo sapiens
  misc_feature 24: n = A,T,C or G
attctatgtaagtgatgacttgtnagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactggtggaagactt

SEQ ID NO: 52569 - DNA, 450 bp, Homo sapiens
  misc_feature 214: n = A,T,C or G
acttagtaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtnggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtagggatgaaacaatttgggagaagatagaagttttgaagtggaaaactggaagacagaagtacgggaaggcgaag

SEQ ID NO: 52570 - DNA, 510 bp, Homo sapiens
agagaggctgttcgcagaagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctataattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgta

SEQ ID NO: 52571 - DNA, 520 bp, Homo sapiens
gatatccgggcacacttcaagagtactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatgggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggct

SEQ ID NO: 52572 - DNA, 324 bp, Homo sapiens
  misc_feature 212: n = A,T,C or G
ataacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggnatttggtctctttgactaatcaccaaaaagcaaccaacttagccagttttatttgcaaaacaaggaaataaaggcttacttctgtaaaaaaaaaaaaaaaaaaaaaaaaaaa

SEQ ID NO: 52573 - DNA, 500 bp, Homo sapiens
gcagagtaggggtctgtcttttaaactctgagtgcaaacttcagagttcttgccttggctgcagtttttttccttcaagaatgcagtactaacatttatttggaggtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgc

SEQ ID NO: 52574 - DNA, 183 bp, Homo sapiens
acgggcggttctgcgtacccctctccgatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtaaaaaaaaaaaaaaaaaaa

SEQ ID NO: 52575 - DNA, 540 bp, Homo sapiens
  misc_feature 16, 36: n = A,T,C or G
aattcagacctagttntataggtatagcagtacgcngtatttatcctggacttcgtatggatctatgtgaggttataatagcacatttctgaggaaataggaacaatccaatagaagtgattctaaaatattttcataagatattcttataaggattccactactctgctctgagttaagaataaaagtaaaagaaaactatctgaatatttattggcctcttaaaaacatgggattgatgacaagttttctgggctgcaaaaattctaatgataaatagagaaaggaaagcaaccaacatttctgagatcagaatggaaaggtttgtgttgtaacataattagggctccagagtgcctatagaatcatagtttatgtccatggtacttagaggttcattcaataccttcctcccagtgtcttctctgtacttgcttatgagttcctcacctggtcattgttaggccagtcatctctcagagtgtttgctttcttcaggccaacagtacgcagccttcttgcatcacgtctgattatctt

SEQ ID NO: 52576 - DNA, 440 bp, Homo sapiens
  misc_feature 223: n = A,T,C or G
atggccgggatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgntataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgat

SEQ ID NO: 52577 - DNA, 386 bp, Homo sapiens
ttgacaagtaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagtaagacagtgcgcttcaacgtgctcaaggtcaccaaggctgccggcaccaagaagcagttccagaagttctgaggctggacatcggcccgctccccacaatgaaataaagttattttctcattcacaaaaaaaaaaaaaaaaaaaaa

SEQ ID NO: 52578 - DNA, 319 bp, Homo sapiens
aggaaactaaacattcccttgaggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacagacaaaaaaaaaaaaaaaaaaaaaaaaaaa

SEQ ID NO: 52579 - DNA, 370 bp, Homo sapiens
  misc_feature 299: n = A,T,C or G
tctggactgtcccttaatttctgctgataaactggaaaacttgtctgcgggctcatttctttcttgtaagatctttccaaatatagtcaaccacccataccattggcattctgctttccacctcttcccttacagccactggctcataggtgcgtgacctgccccgagttactgctgcccagtacatactccttctatgttggtttatttgcatttttgcagcttgcaactaaaaaatgtcccgaccgattgtctcatagcatttgtttgatttacccattaatgatcctccagttggnagatgttttcttcagctgacagatcggggtttgtacttcctgctgtatttaaaattaaactttttacatgc

SEQ ID NO: 52580 - DNA, 460 bp, Homo sapiens
agaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaactttggagtccccaagactcacctagagctaaagaaattaattggaggaggtgtccagtggctccggggagacgttcagctaccctgactttctcaggatgatgctgggcaagagatctgccatcctaaaaatgatcctgatgta

SEQ ID NO: 52581 - DNA, 208 bp, Homo sapiens
  misc_feature 30: n = A,T,C or G
atggccggggagaggagaaaatattttgcntataatgaagaaatttttctagtatataacgcaggccttttattttctaaaatgatgatagtataaaaatgttaggataacagaatgattttagattttccagagaatattataaagtgctttaggtatgaaaataaatcatctttgtctgttaaaaaaaaaaaaaaaaaaaaaaaaa

SEQ ID NO: 52582 - DNA, 440 bp, Homo sapiens
  misc_feature 33: n = A,T,C or G
aaaatgaaaatttactaaatagtttttaaaatntggacttcagcctggcgcggtggctcatgcctgtaatcccagcactgtgggaggctgaggcgggcagatcgcctaagttcacgagtttgagaccagcctgcaacatgaggaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaaataaataaaaccatgggcttccatgctatcttgacaaatttgcactctatagcatcactcaaaatactgcctattggctttaaactccatctgaatactgataactttcacattctttcactagagtgg

SEQ ID NO: 52583 - DNA, 140 bp, Homo sapiens
cttgctgacttagccaaagaagagttaagaagaaaatacacacaagtatacagactgttcctagtttcttagacttatctgcatattggataaaataaatgcaattgtgctcttcaaaaaaaaaaaaaaaaaaaaaaaaa

SEQ ID NO: 52584 - DNA, 275 bp, Homo sapiens
  misc_feature 2, 8, 95, 241: n = A,T,C or G
gnagtggntcacgcctgtctttcccagacactttgggaggctgaggcgggcgaatcacgaggtcaggagttccagaccagcctggccaacatagngaaaccccgtctccactaaaaacacaaaaattagccgggcgtggtggcgcacacctgtattcccagctacttgggaggctgaggcaggagaattgcttgaacccaggaggcaagaggttgcagtgagccgagatcgcgccactgcnctcccgcctgggcgacagagtgagactccgtctc

SEQ ID NO: 52585 - DNA, 120 bp, Homo sapiens
ctcacggtgatgtaaaggactgccgatgtgtactggcttcggctgtgctgtcttctgctttactattaaaacgccacaatcagatgcggatagaacactcttgtgctcagcaccaacacg

SEQ ID NO: 52586 - DNA, 280 bp, Homo sapiens
actgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtcaaaaaaaaaaaaaaaaaaaaa

SEQ ID NO: 52587 - DNA, 470 bp, Homo sapiens
  misc_feature 213, 385: n = A,T,C or G
ttgtgaggttaagcgactaagcgtacgcggtggatgcccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagnaccccgaggaaaagaaatcaaccgagattcccccagtagcggcgagcgaacggggaggagccccagagcctgaatcagtgtgtgtgttagtggaagcgtctggaaaggcgtgcgatacagggtgacagcccccgtacacaaaaaatgcacatattgtgagctcgatgagtangggcgggacacgtggtatcctgtctgaatatgggggggaccatcctccaaggctaaatactcctgactgaccgatagtgaaccag

SEQ ID NO: 52588 - DNA, 400 bp, Homo sapiens
  misc_feature 17: n = A,T,C or G
ggcttgctgggaagagnaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaaataactcagttatggccatctacccctgctagaaggttacagtgtatttatgtagcatgcaatgtgttattgtagt

SEQ ID NO: 52589 - DNA, 230 bp, Homo sapiens
aggttgggaggtggaggcccagcatcccgcgcagtatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtgaaaaaaaaaaaaaaaaaaaaaaaaaa

SEQ ID NO: 52590 - DNA, 390 bp, Homo sapiens
  misc_feature 372: n = A,T,C or G
aacatcccgtaggagcctctctccctactgctgctacacaagaccctgagactgacctgcaggacgaaactatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgcccgngggaccaaatgagactga

SEQ ID NO: 52591 - DNA, 410 bp, Homo sapiens
  misc_feature 117, 217, 321, 330: n = A,T,C or G
atttactttgtttttaatgtatttatatggtttataaccttctttccttgaagtgtcaggaagttcttttaatttcccccatttaatttctaaaagtttgaatggtcatcttatggntgtcatgacttatttatatagttctgttcgtggtatcttgtattgactttttttgtggtttagggtccagaaatgtttttgtcagcttattaaatagagntataaaagcagaatctcaagctagaccttttaatcttatactttataggatactttccccaggttgtgctgattcttttaagataataatgtctgtcttattgngaaaatggnacatactcattaaggtaaattttggtaagccccagaaaaacatatagaagaaaatgaaaataaggtttttctattattaa

SEQ ID NO: 52592 - DNA, 250 bp, Homo sapiens
gatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaa

SEQ ID NO: 52593 - DNA, 490 bp, Homo sapiens
  misc_feature 214: n = A,T,C or G
aggagaactggacgttgagaacagtagttagctggtaaatgtcctcttaaaagatccaaaaaatgagacttctagcaaagattatttgccttatgttatgggctatttgtgtagcagaagattgcaattgaacttcctccagaaagaaaaggccctgtggacatcctggagatactccttttggtacttttacccttacaggaggaaatgtgtntgaatatggtgtaaaagctgtgtatacatgtaatgaggggtatcaattgctaggtgagattaattaccgtgaatgtgacacagatggatggaccaatgatattcctatatgtgaaagttgtgaagtgtttaccagtgacagcaccagagagtggaaaaattgtcagtaagtgcaatggaaccagatcgggaacaccattttggaccaagcagtacgggtttgtatgtaactcaggctacaagattgaaggaggatgaagaaatgcattgttcagac

SEQ ID NO: 52594 - DNA, 290 bp, Homo sapiens
gcaccgaaatgtcttgttttgttgcgacataggaaaataaccaagcacaaagttatattccatcctttttactgattttttttcttctatctgttccatctgctgtattcatttctccaatctcatgtccattttggtgtgagagtcggggtaagggggtactcttgtcaaaaggcacattggtgcatgtgtgtttgctagctcacttgtccatgaaaatattttatgatattaaagaaaatcttttgaaatggctgttttttaaaaaaaaaaaaaaaaaaaaaaaaaaa

SEQ ID NO: 52595 - DNA, 360 bp, Homo sapiens
atatttaaaaatctaggttgtctatccagtatgtgaatgcttaattataattgttacatgttgaatgggtattaagagtaagtcaccaggtacacaaaactgccatcatagcaaaatgagacagtgttgaaaagacaaaatattttctggaatgaaaatatattcaagttgatccatattcagatgttttctgtttaatacttcagattggtcctttgtccacatttgtttaaaacttattgtaatgttaatttatacttttggattgtgcctttgtcatgagttgagaaaagtagtcctacaaataatgtgaaagttgttaccaccacagcatgaatgtataattgtattaaaattgat

SEQ ID NO: 52596 - DNA, 440 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaataaggcttcgattaacatgctgaggattgtagagccatatatt

SEQ ID NO: 52597 - DNA, 440 bp, Homo sapiens
atttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaataggctgtgtactactaattaatagaaaatcattccaccaagagaagagtcaagtgaatatcgg

SEQ ID NO: 52598 - DNA, 400 bp, Homo sapiens
ataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaaatctc

SEQ ID NO: 52599 - DNA, 335 bp, Homo sapiens
aggtattctgaaccggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgtaaaaaaaaaaaaaaaaaaaaaaaaaaaaaaaa

SEQ ID NO: 52600 - DNA, 290 bp, Homo sapiens
gaaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgctaaaaaaaaaaaaaaaaaaa

SEQ ID NO: 52601 - DNA, 330 bp, Homo sapiens
  misc_feature 59, 73, 78, 157, 162, 197, 236, 283, 292: n = A,T,C or G
gctttgaaatatatttaataccacatcaatttaatcttttccctccctctttttttttngttttctgtttttngtttnaaatctgactcttagactctacctacttatagagcagaattagctccccctggggactaattaaaaatgtagacaagantgttnggggtcatgagcttccttaacttcaacctttaaangcataattaatattagtatgggtatagtaggcatgtacnctgaactatttttcaagtaaaaattccaattagtcttgagaaatgcngattttaangtcagtttatctatgtaatgaagactcatccatcttat

SEQ ID NO: 52602 - DNA, 500 bp, Homo sapiens
aataagtccttattaataataacattgaatgtaaatagactaaactcgccaatcaaaagacgtggagtggctgaatgaatacaaaaacaagacccactgacctgttgcctactagaaacactctttatctgtaaagacacatatagactgaaaataaagtgagggacaaagatattccatgctgatgcaaactaaaaagtgggagtagctatatgtatatcagacaaaatagatttcaagacaaaaactataaaaagaggcaaaagtcattatataatgataagggggtcaattcagcaagaggatataacagttatacatatatatgcacccaacactggagcacccaaataggtaaagcaaatattattaagagctgaagagggagagatgggccccacccaatacaataagagctggagacttcaataccccacttttcagtgttggacagataatcgagatagaaaaatttacgtaatctgccctatatatcaaat

SEQ ID NO: 52603 - DNA, 949 bp, Homo sapiens
  misc_feature 8, 17, 23, 24, 25, 559, 574, 620, 670, 689, 712, 713, 714,715, 716, 717, 718, 721, 722, 723, 728, 731, 732, 733, 734,735, 736, 737, 738, 739, 752, 753, 755, 756, 760, 761, 762,763, 764, 773, 774, 777, 786, 806, 811, 812, 813, 814: n = A,T,C or G
  misc_feature 815, 816, 817, 818, 819, 820, 821, 822, 823, 824, 825, 826,827, 828, 829, 830, 831, 832, 833, 834, 835, 836, 837, 838,839, 840, 841, 842, 843, 844, 845, 846, 847, 848, 849, 850,851, 852, 853, 854, 855, 856, 857, 858, 859, 860, 861: n = A,T,C or G
  misc_feature 862, 863, 864, 865, 866, 867, 868, 869, 870, 871, 872, 873,874, 875, 876, 877, 878, 879, 880, 881, 882, 883, 884, 885,886, 887, 888, 889, 890, 891, 892, 893, 894, 895, 896, 897,898, 899, 900, 901, 902, 903, 904, 905, 906, 907, 908: n = A,T,C or G
  misc_feature 909, 910, 911, 912, 913, 914, 915, 916, 917, 918, 919, 920,921, 922, 923, 924, 925, 926, 927, 928, 929, 930, 931, 932,933, 934, 935, 936, 937, 938, 939, 940, 941, 942, 943, 944,945, 946, 947, 948, 949: n = A,T,C or G
cttctttncccgggaanctcggnnnttatggccggggtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatattgattgaaaaaaaaaacagttcacctcttaatacttcacaagatacttgagctgttcttgggagattcacttttattattgggagcactgcataattaatgggggtttttaaattaaaagaaatattcctttngttcctcaaccttgnaaataaagacttttttttctagagacaaatttgattgtataccacnattttttcttaaacattttattttggtggaaatatctttaaatggccagnggcaggggaatttagaaanaaaaagggggttttggccctccnnnnnnnaannnaaaanaannnnnnnnntttgggggcgccnngnncccnnnnntttttattnnganaattttttncgggccaattggctgctttnccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52604 - DNA, 234 bp, Homo sapiens
  misc_feature 135, 147, 150: n = A,T,C or G
acaattctacaccaaattgtctcttcaaatacgtatggactggataactctgagaaacacatctagtataactgaataagcagagcatcaaattaaacagacagaaaccaaaagctctatataaatgctcagagntctttatgtatnggnttattggcattcaacatatgtaaaatcagaaaacagggaaattttcattaaaaatattggtttggataaaaaaaaaaaaaaaaa

SEQ ID NO: 52605 - DNA, 332 bp, Homo sapiens
  misc_feature 205: n = A,T,C or G
aacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactnctttttattcatacgtaaaattttggattaatttgtgaaaatgtaattataagctgagaccggtggctctcttcttaaaagcaccatattaaatcctggaaaaccaaaaaaaaaaaaaaaaaaaaaa

SEQ ID NO: 52606 - DNA, 330 bp, Homo sapiens
  misc_feature 44, 56, 66, 85, 93, 129, 152, 274: n = A,T,C or G
gtgattctaagatttggtttgggatcaataggaaagcatatgcngccaaccaagangcgaatgttntgaaatgatatgaccaaanttttaagnaggaaagtcacccaaacacttctgctttcacttaantgtctggcccgcgctactgtagnaacaagcatgatcttgttactgtgatattttaaatatccacagtactcactttttccaaatgatcctagcaattgcctagaaatatctttctcttacctgagatttatcaatttttcccagnatttttatacggaaaaaattgtattgaaaacacttagtatgcagttgataagaggg

SEQ ID NO: 52607 - DNA, 336 bp, Homo sapiens
  misc_feature 10, 25: n = A,T,C or G
caaggcctcntactctccggtttcntgttgcgtcttgttgagggagggagagcaggttacttggcaaccatattgtcacctgtacctgtcacacatcttgaaaaataaaacgataatagaactagtgactaattttccctttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgggggttttgc

SEQ ID NO: 52608 - DNA, 300 bp, Homo sapiens
  misc_feature 14, 49, 66, 137, 202, 213, 244: n = A,T,C or G
cccttttggaaganccttgctttggaaagaagccctggaccacttaacnaatttctaccacccaantttgtcttctttcaaaataccgtattgggaccttggataaaccttcttgagaaaaccacattcttaggtantaacctgaattaaagccagagccattcaaaattaaaaccagaccagaaacccgaaaagcctcttntattaaatgcntcaagaggttcttttaatgtattttcctttntttggcatttcaaccattatggtaaaaatccagaaaaacaggggaaaattttcatt

SEQ ID NO: 52609 - DNA, 340 bp, Homo sapiens
  misc_feature 21: n = A,T,C or G
tctgggtggctttgtcccttntggtgaaagtgacccaatgactttgtcatgctgaaaggctgtgtggtgggaacccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcaggttggtggggtctcaataaaagttattttccaccaaaaaaaaaaaaaaaaa

SEQ ID NO: 52610 - DNA, 134 bp, Homo sapiens
  misc_feature 90: n = A,T,C or G
atggctcacacctgtaatcccagcgctttgggaggctgaggcgggtggatcacaaggtcaggagatcgagaccatcctggctaacatggngaaaccctgtctcttctaaaaaaaaaaaaaaaaaaaaaaaaaaa

SEQ ID NO: 52611 - DNA, 285 bp, Homo sapiens
  misc_feature 32, 42, 258: n = A,T,C or G
gagaaaccctttgtaaaactcaaatgaccacntaaagcttantcaaggagtctagattggttttgttttactaccctatgggatgaagaaaatagaaatgtcagtagaactcattgagggtgctcttgcaagctgctgaaaatagaagttggctactctcagaatttggtttaaagctggacagatttgctttgttatagggtaaagctttgtctaaagtcctcattttcttttaaaattgaataaaatttctgtgtnccaaaaaaaaaaaaaaaaaaaaaaaaa

SEQ ID NO: 52612 - DNA, 410 bp, Homo sapiens
  misc_feature 6, 28, 30, 210: n = A,T,C or G
caacantaatgggtacctctttttttcnantttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgnccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagt

SEQ ID NO: 52613 - DNA, 390 bp, Homo sapiens
  misc_feature 31, 359: n = A,T,C or G
tacaaatgaaacccatggaatgatgacttcntgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattattttgttgncctttactactgtaaacagtaaatataggtt

SEQ ID NO: 52614 - DNA, 250 bp, Homo sapiens
gacgctggggatgctggtacaaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 52615 - DNA, 450 bp, Homo sapiens
  misc_feature 25: n = A,T,C or G
aaagaggaggggcaccccgatattntgttctcttaggcctttttagaaaacctggagttgttccttttggccacatatatgcgaatctattaagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcccgaaacgtgtgaaggaaaatgatcagaaaaagaaagaagccaaagagaaaggtaccttgggttcaactaaagcgccagcctgctccacccagagaagcacacttttgtgagaaccaatgggaaggagcctgagctgctggaacct

SEQ ID NO: 52616 - DNA, 230 bp, Homo sapiens
  misc_feature 10: n = A,T,C or G
cagtgcaganttttttgttatggtgaaacaggttttccaaatagccagtagttagttaatatatactaaatcatttggaaatatggtcataattgttgcttcttttctattgctaaagaataatatcaatttgtatttttttactttagtaattctgttcaaagaaaatacagtgatttatttctattatatttaataaaaattaatttatgctggaaaaaaaaaaaaaa

SEQ ID NO: 52617 - DNA, 400 bp, Homo sapiens
aggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaagg

SEQ ID NO: 52618 - DNA, 450 bp, Homo sapiens
agaaaagagtgcctactccataggcagagcagccccaagggccactagttggctatttttatgcttatttctttttttaattcatttatttttcaaatggagtattatttcttgatcttatgctaaacaaggggtgggttattcatgaggttttccggaaaggagcagccattcctggaactgagggttccccccgctttcagaccacatagggtaacttccaagtgttgccatggcgtttgtaaactgtcctggcgctggtgggcgtgtcttttagcatgctcatttgttataatgagtgtatcgtgaatagtgaggacaaccagaggtcacttcagttgtcatcttggttttggcgggcttcgatccacttatgtaccgcatcttgtttcagcagcggggtcctcgtgacctgtaccttgcaaaacctgtcctgacaaactcctgtct

SEQ ID NO: 52619 - DNA, 218 bp, Homo sapiens
agtttgagaccagcctggacaatatggtgaaaccctgtctctactaaaaatacaaaaattagctgggcatggtggcgggcgcctatagtcccagctacttgggaggccgaggcagcagaattgcttgaacccgggaggtggagggtgcagtgagtcgagatcgcgccactgcactacagcctgggcgacagaacaagactccatctcaaaaaaaaaaa

SEQ ID NO: 52620 - DNA, 450 bp, Homo sapiens
  misc_feature 2, 7, 446: n = A,T,C or G
anttcantgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatatttttttgtcctgttattaacttgtaagccctagtaatggccaattatttgtacagcaacagaagtaaattgaagatactggctaagactggattgattgtggacttttatactatattgcagaaaccaatatctgnttct

SEQ ID NO: 52621 - DNA, 245 bp, Homo sapiens
  misc_feature 32, 37: n = A,T,C or G
ctggaacctggatcagactccttgaaaagaantgtantttctaactgcctgatgcggtcggtctactagaatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaactaaaaaaaaaaaaaaaaaaaaa

SEQ ID NO: 52622 - DNA, 344 bp, Homo sapiens
agaaatgataggtaaccaggtccaatcagtaaaaataagctgcttacaactggaaatggccattgagctgtttcctcacaattggcgagatcccatggatgagtaaactgtttctcaggcacttggaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccatt

SEQ ID NO: 52623 - DNA, 327 bp, Homo sapiens
  misc_feature 22, 62, 157, 189: n = A,T,C or G
ttgtccccaagcaggacctctnctttcaaaccaaaatttaaacctgttttgtggccctactntgtgtttaactccctggttaaagacaaagcttcataaatgcttgttttttcttcaaccaccattaacccagctgtaaaaacaccagacccttttntcaagaggtaggcaaagatttttcaggattcntataccagatagactattaaagtcatgtaattttgaaaagcagtgtttcatttattgaaaagagctctcaagttgcttgtaaagctaatctaattaaaaaagatgcataaatgttgttgaaaaaaaaaaaaaaaaaaa

SEQ ID NO: 52624 - DNA, 470 bp, Homo sapiens
  misc_feature 50, 388: n = A,T,C or G
agtaaagtgcatgaggaacaaatctgcatacttttgctgaaaagctctantaaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagcttgcctcctagaatatagactgnctgtatttattattcacctataattagtcattatggatgctttaaaagctggacctttgcatttcaaagcttataagatata

SEQ ID NO: 52625 - DNA, 226 bp, Homo sapiens
  misc_feature 28: n = A,T,C or G
ctctttctcctaccctgttctttctcantttttcccagtattttttctaccggaaaaaattgtatttgaaaacactttagtatgcagttgataagaggaatttggtataattatggtgggtgattattttttatactgtatgtgccaaagctttactactgtggaaagacaactgttttaataaaagatttacattccacaaaaaaaaaaaaaaaaaaaaaaaaaa

SEQ ID NO: 52626 - DNA, 310 bp, Homo sapiens
  misc_feature 37, 178, 200: n = A,T,C or G
gaaaggtaggcagagtctgcattgcctagaacaatgnagggaacggaaccaggaattgcaacatatgctccttctccaggtggcctgtgcttctccttaaatgtttcagttcagactaggttctccatcagaaggaaaatatgccagggaagataagctatttcaaagggagtgaaancagttgggtttggcttaacccnttttgacagtgttactagaggcctttacaatgattgttggtggggagcataatttgacttctttcttgaaccctaagaaaggaccctgggttccatcagggaaaataaaa

SEQ ID NO: 52627 - DNA, 570 bp, Homo sapiens
  misc_feature 326, 446, 557: n = A,T,C or G
tgtggaaggtttctaggaatggattgcttagtctaaagtaagcactaccaccatccacgttttcactcaacacagtgccttttaattggtgactaacatcaaaacaccttgacaaaccgttaaaacagtatcaggaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgtnatttaagtatatggccttccagacttttctgtgcatttatagatatttttaatgggatcaaagtgtacatactgttttgtaactttttttcactcaacaataccatgactgtcttgctgngtcaagtatatttctacatctcttaatggctgcatgatattccatcatatgtgccacattttattaaactactggtcaatttttaggggttccaactttcattaataaagngctttaaggaccg

SEQ ID NO: 52628 - DNA, 510 bp, Homo sapiens
  misc_feature 43, 58, 209: n = A,T,C or G
ctcagcatttggggacgctctcagctctcggcgcacgggccancttccttcaaaatgnctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtggggntgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaag

SEQ ID NO: 52629 - DNA, 250 bp, Homo sapiens
  misc_feature 5, 22, 70, 105: n = A,T,C or G
aggcnttgaggcagcccgcgcnggggcttcttgcttgagggggcaggcggagcttgaggaacccgcaganaagttttttttctctttgaaagatagagattaatnccaactactttaaaaaatatagtcaataggttactaagatattgcttagcgttaagtttttaacgtaattttaatagcttaagattttaagagaaaatatgaagacttagaagagtagcatgagaaaaaaaaaaaaaaaaaaaaa

SEQ ID NO: 52630 - DNA, 469 bp, Homo sapiens
  misc_feature 18, 33, 37, 45, 71, 469: n = A,T,C or G
tggaaatgtgggcaaganctgtctttgaactcnagancacagaantgtggcacgctttgcccctccaagantcttgcttccctgtggatgttggtggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttagggtttaagatgaccaatgacaatgaccacctttgcagaaagtaaactgattgaataaataaatctccattttcttcaatgcaaaaaaaaaan

SEQ ID NO: 52631 - DNA, 320 bp, Homo sapiens
  misc_feature 168, 235: n = A,T,C or G
aatctgtaactcgcattttaatgatcagctattataaacttttaatagcatgaaaattgttaggctatataacattgccacttcaactctaaggaatatttttgagatatccctttggaagaccttgcttggaagagcctggacactaacaattctacaccaaattgnctcttcaaatacgtatggactggataactctgagaaacacatctagtataactgaataagccgagcntcaaattaaacagacagaacccgaaagctctatataaatgctcagaggtctttatgtatttcttattggcattcaacatatgtaa

SEQ ID NO: 52632 - DNA, 420 bp, Homo sapiens
gtccgcaccgcttcctgctcctgactcacccgcttgttcgcttcttcgccgaggaacaagtcggtcaggaagcccgcgcgcaacagccatggcttttaaggatacccggaaaaacacccgtggagccggaggtggcaattcaccgaattcgaatcaccctaacaagccgcaacgtaaaatccttggaaagggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttg

SEQ ID NO: 52633 - DNA, 313 bp, Homo sapiens
gtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcgggcctgctgcaggagctctgagaacaagaaagagtggacacccgttcccctgcatcatctgtcttgcgtgctatttcagaggggggaagtgataaactatttgccttctggagctctttgtgaaaaattaaaaaaaaacttagcacaaaaaaaaaaaaaaaaaaaaaaaaa

SEQ ID NO: 52634 - DNA, 113 bp, Homo sapiens
  misc_feature 31: n = A,T,C or G
taccagaatctctgggacacattcaaagctntgtgtaagagggaaatttatagcactaaatgccctcaagagaaagctggagagatggaaaatggacacccttcatcacactt

SEQ ID NO: 52635 - DNA, 203 bp, Homo sapiens
  misc_feature 133: n = A,T,C or G
ccaccacgaaataccgatcaaatgctcttagatgtcctggcaccatcctagtgaagatctggattttgctgcatttagcccatgctgcttctggctgtcttaatgctggcattaagatcatgagcccttttcnccagagtacaggctttgaaactactctattaagtattgagcactttgaatttttcataactatatttaac

SEQ ID NO: 52636 - DNA, 361 bp, Homo sapiens
  misc_feature 24, 193, 265, 309, 334: n = A,T,C or G
gccctgtgttgtgctcaggactcnttctgccgctggtggaaactcatggcttgtctctctctttgatcccataaagctacgagggggacgggagagggcagtgcaatgggaagtaaagagatattttccagtaggaaaagcaatgctttcttgtctttagactcaaatgcttagggaacgtttcatttctcantcatggggaaaggcagcctccttaaatgttttctgaagagcggtgaaatctagaagcttaggaatttacagntccttcaataaccatgatgacctgaagttcacctatgccatttnagcatctacttgtttttcccatctnttcctttccaatttgcttatactgctg

SEQ ID NO: 52637 - DNA, 234 bp, Homo sapiens
  misc_feature 13, 35, 206: n = A,T,C or G
catacatcttccntgactctcctgggggcaccttnctatgatagatacgattgctacaagggcccagaatgggcttagatgactgcatccttcttgagaaggcaatgtatcctgattactttgcaagagagaacagtggaagaaactgcggagggaaagctgggaacgaagaggttaagcagctgcaggaggaaacgccacctggnggtcctttaactggaagctttgccccct

SEQ ID NO: 52638 - DNA, 244 bp, Homo sapiens
attaatgacacaaaaaatgaaaatggtaaatttgtattttgagagtctaatagcctaatttacctgaactggctttcattgagttaaaacttaatatggatggattcttttgtggctcataagcttgggattttcacactagacattcttaactcatgaggttgggacttcacattaatctctaatctttgagattgcctccctcaaaccttgctacagtattggcacattacccatctcacag

SEQ ID NO: 52639 - DNA, 384 bp, Homo sapiens
  misc_feature 13, 59: n = A,T,C or G
gcactctcgcctncagcatgaaagtctctgccgcccttctggcctgctgctcatagcangccaccttcattccccaagggctcgctcagccagatgcaatcaatgccccagtcacctgctgctataacttcaccaataggaagatctcagtgcagaggctcgcgagctatagaagaatcaccagcagcaagtgtcccaaagaagctgtgatcttcaagaccattgtggccaaggagatctgtgctgccccaagcagaagtgggttcagggattccatggccacctggcaagtaaacccaaactccgaagacttgaacactcactccacaacccaagaatctgcagctaacttattttcccctagctttccccagacaccttggt

SEQ ID NO: 52640 - DNA, 408 bp, Homo sapiens
  misc_feature 22, 68, 72, 202, 269, 380, 391: n = A,T,C or G
ttcttgctgagggggcaggttngagcttgaggaaaccgcagataagtttttttctctttgaaagatanagantaatacaactacttaaaaaatatagtcaataggttactaagatattgcttagcgctaaggttttaacgtagttttaatagcttaagattttaagagaaaatatgaagacttagaagagtagcatgagganggaaaagataaaaggtttctaaaacatgacggaggttgagatgaagcttcttcatggagtaaaaaangtatttaaaagaaaattgagagaaaggactacagagccccgaattaataccaatagaagggcaatgcttttagattaaaatgaaggtgacttaaacagcttaaaggttagnttaaaaggtgnaggtgattaaaataatt

SEQ ID NO: 52641 - DNA, 301 bp, Homo sapiens
  misc_feature 107: n = A,T,C or G
gagctacccctcccctgctgtaacttacgtgacctgtgctgtcactgggcataggacagcggcatcacggttgcattcccattggactcatgcacctcccggatggnttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaa

SEQ ID NO: 52642 - DNA, 352 bp, Homo sapiens
  misc_feature 66, 234: n = A,T,C or G
cacagtagagcatacttaaggctgcttggtactgagtatacttaaatataactccagaatccaggnacttggtgttaaaacaggattagagcatgtaaaggtacatctagattcatatttgaatcttaaactgtatttttctcttagtattgctaatgagtaaagaaaagcctcataaggtagccaaatgaaaaagaatgaaagggaaagtgaaaaattaaggggacaaaagangggatgtgaaaagaagaattctaggtttgatgggactcatattcacgataggatacaaagtgtgatttggtggaaacatggtcccaaattctaaaattctgctctctgccaaaagcaa

SEQ ID NO: 52643 - DNA, 322 bp, Homo sapiens
acacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcca

SEQ ID NO: 52644 - DNA, 381 bp, Homo sapiens
agcaatgactgtgctcacccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaagggctcctcttttttctggcattgctggcaagattactaatatttgggaagctttaaaggcgcatgtaatggggctaatgacttcacttttaaa

SEQ ID NO: 52645 - DNA, 95 bp, Homo sapiens
  misc_feature 27: n = A,T,C or G
tggagctgaatcagacgctgacagttnttcaggcatttctatttcacaatcgaattgaacacattggccaaataaagttgaaattttaaaaaaaa

SEQ ID NO: 52646 - DNA, 377 bp, Homo sapiens
  misc_feature 113: n = A,T,C or G
agttagatgcaaaataactctacaaaagagattattttttacaaagtagatgacattaattcaagaaaaaaagtattttaagtttcttcctgaaagaccttttaatttcttgnattttctaggccaggtggaagatattcttcctaaaaaatggcttcagattacctctaaaccttctctttgacacctggctgagaacccagaaaacaccccctgtccatagcagaccagtgttactggtatttgcctctttagagcagtcagaggaccatcagctaccatacccactaaacgaaaatggcaaaaggacttgtaatggccaaatgcagcaatataattggtattatcaatcactagtgatttgaaatattgagaaa

SEQ ID NO: 52647 - DNA, 218 bp, Homo sapiens
tttattcgttctaagatgaaagtcattcattctggatggctatgaccttgagcgactcacttctctccaggctccaggtgtccccttcattcatttgttaacctttattaagcacctcccatgggccgcagtcaggccctggggattcagcagtgaatgaaactgacaaaacccctgacctcattaaactgacattcttttttttcaaaaaaaaaaag

SEQ ID NO: 52648 - DNA, 311 bp, Homo sapiens
  misc_feature 32: n = A,T,C or G
gccctttgctctggagggagttctccagcttnagctcaactcacagcttctccaagcatcaccctgggagtttcctgagggttttctcataaatgagggctgcacattgcctgttctgcttcgaagtattcaataccgtcagtattttaaatgaagtgattctaagatttggttgggatcaataggaaagcatatgcagccaaccaagatgcaaatgttttgaaatgatatgaccaaaattttaagtaggaaagcacccaacacttctgcttcacttaagtgtctgggcccgcaatactgtaggaacaagc

SEQ ID NO: 52649 - DNA, 379 bp, Homo sapiens
gagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgcctgacagagcgctccttgatgggcatggctggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctcttgagagcttttgacatgattaatcgat

SEQ ID NO: 52650 - DNA, 382 bp, Homo sapiens
  misc_feature 22, 220, 284: n = A,T,C or G
tgttcgtgatatgagacagacngttgcggtgggtgcatcaaagcagcggacaagaaggctgctggagctggcaagggtcaccaagtctgcccagaaagctcagaaggctaaatgaatattatccctaatacctgccaccccactcttaatcagtggtggaagaacggtctcagaactgtttgtttcaattggcatttaagtttagtagtaaaagactggntaatgataacaatgcatcgtaaaaccttcagaaggaaaggagaatgttttgtggccactttggntttcttttttgcgggggcaagtttaagttattagttttaaaatcagtactttttaatggaaacaacttgccaaaaatttgcacagaattttgagaccc

SEQ ID NO: 52651 - DNA, 413 bp, Homo sapiens
  misc_feature 29: n = A,T,C or G
catcagatctgaaatatttaaagtggatncaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcaggcaagaggattatgacagattacgaccgctgagttatccacaaacagatgtatttctagtctgtttttcagtgggcctctccatcttcatttgaaaacgtgaaagaaaagtgggtgcctgagataactcaccactgtccaaagactccttcttgcttgtgggactcaaattgatctcaagagatgacccc

SEQ ID NO: 52652 - DNA, 408 bp, Homo sapiens
  misc_feature 266, 359: n = A,T,C or G
ttcgggccgagatgtctcgctccgtgttcttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgnactacactgaattcacccccactgaaaaagatgagtatgcctgccgtgtgaaccatgtgactttgtcacagcccaagatagttaagtggatcngagacatgtaagcagcatcatggaggtttgaagatgccgcatttggatt

SEQ ID NO: 52653 - DNA, 390 bp, Homo sapiens
  misc_feature 31: n = A,T,C or G
atcgtgacccgagaccgtgaccgagagcgtnacccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagcaagtaaatgcttgtttttg

SEQ ID NO: 52654 - DNA, 385 bp, Homo sapiens
tgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgtttgcagatttgaaagttcagttgtatgcaaaattcgggagcaacataaaccttgaagctgatgaaagttaaacatttataatacttttttat

SEQ ID NO: 52655 - DNA, 231 bp, Homo sapiens
  misc_feature 16: n = A,T,C or G
acctgaagtcaggagntcgagacgagcctggccaacatggttgaaaccccgtctctactaaaaacacaaaaattagccaggcatggcagcccatgcctgtagtcccagctactcaggaggctgaggcaggagaattacctgaatccgggaggcagaggctgcagtgagccgagatcgcaccactgcactctagcttgggtgagagtgagaacagagaaagactccatctaa

SEQ ID NO: 52656 - DNA, 334 bp, Homo sapiens
  misc_feature 175: n = A,T,C or G
gtatttctaattgcttcacactttacaggtttaatacaaagtacaaagctctacttttataacgtgtactacaagtttctttaaaagtattggtgtatttcagctgactcttgtatctgcagtcttttggtatttctgcagctacacccttaatttgcagaggccattttgttgnttgtttgatgctgaagctgtggtaaaatgccccaaactccaaggcagattgtctgtataatacgctatagctttcaccatggggggtttaccagctgtactctgtattttaaaaagccagagattctctgtctaactgttctatagcatttctaaacaa

SEQ ID NO: 52657 - DNA, 370 bp, Homo sapiens
  misc_feature 290, 292: n = A,T,C or G
aaaaatgatacttctcttttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttccgaaatagcaaatacgaaattagaaaagccctccctattttaactacctcaactggcagaaacacagatgnantctatggagtcccagaagatgaaaaaaattttatacgtgataaaacttataaattcattgataaatctcctggaagat

SEQ ID NO: 52658 - DNA, 180 bp, Homo sapiens
tctctactaaaaatacaaaaactagttaggtgtggtggtgcccacctgtaattccagtttctcaggaggctgaggcatgagaatcacttgaacccaggaggcagaggctgcagtgagcagagatcacagccactgcaccccagcctgggtgacgaagtgagactctgtctgcgaaaaaaa

SEQ ID NO: 52659 - DNA, 241 bp, Homo sapiens
  misc_feature 26, 216: n = A,T,C or G
gccagcccaggctggagcgcaatggngcgatctaagctaactgcaacctccgcctcctgggttcaaatgattttcctgcctaagcctcctgggtagctgggactacgggtgcccggcaccaccgcctgactaatttttgtattttcagaagagacggagtttcaccatcttggccaggctggtctcgagctcctgacctcgaaatccacccgcctnggctcccaaaggctgggattacagg

SEQ ID NO: 52660 - DNA, 407 bp, Homo sapiens
  misc_feature 25, 52: n = A,T,C or G
gctgtggttgctgtttgcggtggtntagggaggaagaagttgcacacttggnaacggctgctgcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggccctaaagtttgtaacatcag

SEQ ID NO: 52661 - DNA, 402 bp, Homo sapiens
tctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgctggccgcaatactgtaggaacaagcatgatcttggtactgtgatattttaaatatccacagtactcacttttccaaatgatcctagtaattgcctagaaa

SEQ ID NO: 52662 - DNA, 386 bp, Homo sapiens
  misc_feature 53: n = A,T,C or G
tgggggatacaccctacaaacatttaatacaactcaggaagacacatgacttntacttccactatgaccattagccattatatgatttatctcaacgctggcagaaacaaaccgagcaccgttcgatcttacagagggggaatcagaactagtctcaggcttcaatgtagagtatgcagcaggaccatttgccttattctttttggctgagtactcaaatattttactaataaacaccctctcaacagtactatttttaggagcatcgtttaccccagatgcacctgagctaataacaatcagtattgcaaccaaaactgcaatactatctattttggttctctgaatacgagcatcatacccacgattccgatatgaccaactta

SEQ ID NO: 52663 - DNA, 379 bp, Homo sapiens
  misc_feature 29, 92, 158, 352: n = A,T,C or G
ttaactgttagtccaaagaggaacagctntttggacactaggaaaaaaccttgtagagagagtaaaaaatttaacacccatagtaggcctanaagcagccaccaattaagaaagcgttcaagctcaacacccactacctaaaaaatcccaaacatatnactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcangctcataaggaaaaaaaaaaaaaaaaa

SEQ ID NO: 52664 - DNA, 354 bp, Homo sapiens
  misc_feature 23: n = A,T,C or G
ttcttaaagaatttaaacctggnaggagtcatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggatggctttggatctctcttccaagcctttcctgacttcctcttagatcatagattggacctggttttgttttcctgcagctgttgacttgttgcctgaagtacaataaaaaaaattcattttgctccagt

SEQ ID NO: 52665 - DNA, 319 bp, Homo sapiens
tcgaaggaagattatgtcttcccctctttccaaagagctgagacagaagtacaacgtgcgatccatgcccatccgaaaggatgatgaagttcaggttgacgtggacactataaaggtcagcaaattgcaaagtagtccaggtttacaggaagaaatatgttatctacattgaacgggtgcagcgggaaaaggctaatggcacaactgtccacgtaggcattcaccccagcaaggtggttatcactaggctaaaactggacaaaagaccgcaaaaagatcctcgacggaaagccaaatctcgccaagtaggaaaggaaaa

SEQ ID NO: 52666 - DNA, 404 bp, Homo sapiens
  misc_feature 23, 176, 204, 333: n = A,T,C or G
tgtaaatgaagtaatactgtgtncctcttgtctgttatttttcttagtagggggcctttggaaggcactgtgaatttgctattttgatgtagtgttacaagatggaaaattgattcctctgactttgctattgatgtagtgtgatagaaaattcacccctctgaactggctccttnccagtcaaggttatctggtcgattgcanaatttgcaccaagaagttaaaatgttttatgactctctgttctgctgcaggcagagagcacattgtgtaatttaattcagcagcaatagatggcatccctcatcagggttgccagatggggataacagngaaggccttggtctaaggcatccacgactggaaggactactgatgttctgtgatacatcaggttcagcaca

SEQ ID NO: 52667 - DNA, 204 bp, Homo sapiens
gaggtcgagaccaccctgttcaacatggtgaaaccctgtctgtactaaaactacaaaaaaagtagcctggtgcatgcctgtagtcccagctactcaaaaggctgaaacaggagaatcgcttgaacctgggagctggaggttgcagtgaggccgagatcatgccactgcactccagcctgggcaacacagcgagactccatctca

SEQ ID NO: 52668 - DNA, 297 bp, Homo sapiens
  misc_feature 29, 34: n = A,T,C or G
ttttaagtcctccgaatcttatttactanctggntctcttattatttcccacatgtataatcttaagtttagattagcaattcgggatctctttttccctgaattctaaccattaagccaagcaagcattttgggtggagccactagccaaggtgggaagtagaaagaagaccaaggtggaagtgaagggagagatggggagaatgcaccagaactagtgggagggaattgccttttctttcaagggctgtaagtctgcagtaaaagcaaaggtattcaaataggagttttgttttg

SEQ ID NO: 52669 - DNA, 380 bp, Homo sapiens
  misc_feature 351: n = A,T,C or G
gttgcacaggtgtaaggaccatataatctgggtttatttaggtaacaataaaagatagaaaatctcatattacagaaattttaaaattgactatataataaatgattaggaaaactaaaaatagaacaggacaatgttcaaatagataataaaattaacaaatggggccaaaagatcaacacatatcctgcatcatctttcatgtagtgtctcagctttctttttcccaaacataaaggcagattaattcaaactagccctattaagaatattagtttgccaggtgcagtggctcaagcctgtacccagcctaaaaaatattttctaattcaaagacatgtaggccggcgnggtgactcatacatgtaatcccagcactt

SEQ ID NO: 52670 - DNA, 333 bp, Homo sapiens
  misc_feature 74, 167, 194, 224: n = A,T,C or G
atcttttcttcttacacagtgtctggagaacatttacattatagataagtagtacatggtggataacttctacntttaggaggctactctcttctgacagtcctagactggtcttctacactaagacaccatgaaggagtatgtgctcctattattcctggctttgngctctgcaaacccttctttagcccttnacacatcgcactgaagaatatgatgctganggatatggaagacacagatgatgatgatgatgatgatgatgatgatgatgatgatgaaggcaactctctttttccaacaagagagccaagaagccatttttttccattt

SEQ ID NO: 52671 - DNA, 276 bp, Homo sapiens
  misc_feature 18, 70: n = A,T,C or G
aggacacatgaagcagangggaaagaagtaggcagaaatgagcagttcgctcctccctgataagagttgncccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 52672 - DNA, 352 bp, Homo sapiens
acagtttcaaagaaaaccaccctagtgatttatctccagtgcacaattcagtcagctcctgcacctgttatgttatttgtggctttaaaagaattggtgcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgcacttgatgattctatatccgaaataaaacaaattaatcattta

SEQ ID NO: 52673 - DNA, 129 bp, Homo sapiens
ctctatcagctatggaaaaaagatttatgtgcctatgtgtcaagcaacatggtaatactttcttacctgtagtatcaattattgctttgtatgaagtaggcctttctatgttgatttaacaaaaaaaaa

SEQ ID NO: 52674 - DNA, 405 bp, Homo sapiens
  misc_feature 287: n = A,T,C or G
gccaaccatcggttgtttggcagcaagctttgaacgtagccgcctgtgaactcaggaatgcacagttgacttgggaagcagtattactagatctggaggcaaccacgggacactaaacttctcccagcctcttcaggaaagaaacctcattctttggcaagcaggaggtgacactagatggctgtgaatgtgatccgtcactgacactctgtaaaggccaatcaatgcactgtctgctctccttttaggagtaagccatcccacaagttctataccatatttttagntgcagttgaggttgtagatacactttataacattttatagtttaaagagctttattaatgcaataaattaactttgtacacattttatataaaaaaacagcaagtgattcagaatgtg

SEQ ID NO: 52675 - DNA, 383 bp, Homo sapiens
aggcgacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctgtcagacagataaataggaaaacaccagtggaaaagaagaagcctaaaaagaaatcatgtctgctgctctaggccc

SEQ ID NO: 52676 - DNA, 226 bp, Homo sapiens
  misc_feature 190: n = A,T,C or G
tgggaagggggaatttgaggtggttgggaatgtcatggtactgtctgaaagattgacagtaaagaagacaagaaatatatgtatgtaggtatgcatattaagtttttgcccaccaagcctatctttggaatggcaaacattttaaaaacatctggtctagttgccaactactctagcttctttataaagnaaacaatcttaaagtaagccaatgtgggcataattt

SEQ ID NO: 52677 - DNA, 409 bp, Homo sapiens
  misc_feature 35, 387: n = A,T,C or G
aatgtggtgcacactccgaaacttttatctactgntttgtaagcctccaagggtggcattacagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggaatctggaattggttagagactgttaataagggacatcacaaggtgatgggattcatttgaagcactctatttctggttttaatggtttaatccaatttgccttcccaagattttngtctacataaaaagtcatgcca

SEQ ID NO: 52678 - DNA, 236 bp, Homo sapiens
atttttgttaagcaaaagattaaatgtgttattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcacaagt

SEQ ID NO: 52679 - DNA, 313 bp, Homo sapiens
cttgctaggtatcctgggtcaagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgctgttagttatttctccaggggaaaaggcaataattttctaagacccgtgtgaatgtgaagaaaagcagtatgttactggttgttgttgttgttcttggtttttataggtgtaaaataaaaatagtaaaagg

SEQ ID NO: 52680 - DNA, 412 bp, Homo sapiens
atgctcagttgtcacatcaaaggatacagtattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaatggtagggaggcttggagctattagttaatctatcttccaatacactgtttaatatagcactgaataaatgatgcaagtggcaatggatgagggacaactaatagctctgctagtaattg

SEQ ID NO: 52681 - DNA, 410 bp, Homo sapiens
tgaagaagactcatgagaagtttttgttgatcacgcaaaattctggggcagtaatgacctcaggacttggggaagcagattcctgtggaaagattgtacctaatacagcagatgacttcatgacaatattgagtgtgcaaatctaggatcatgatctgctgcgctagcagaagcagcagtcatctcaggggaggtgttgcctgagatgagtgtttccttgttgacactgtgcttagctacctggcaactaagcactagagacgggattattccctgttggatttctagcataacagttccatcaaaaacagaagaaactgcaaaagagcaagtacctttgcagggaacattcacaaccccagtgactttccaacccttcagaaatagctgtatttccaactgtaaaaatt

SEQ ID NO: 52682 - DNA, 119 bp, Homo sapiens
cagttgagctgctgttttcttccatgcaatattgtatactcaattgtgtatagaagaagctggtgagagtgccctcctacataaataagcaattgcagtgttttgcatgcaaaataaaa

SEQ ID NO: 52683 - DNA, 150 bp, Homo sapiens
gtgcctaccatggtgaccacgggtgacggggaatcagggttcgattccggagagggagcctgagaaacggctaccacatccaaggaaggcagcaggcgcgcaaattacccactcccgacccggggaggtagtgaccaaaaaaaaaaaaaa

SEQ ID NO: 52684 - DNA, 373 bp, Homo sapiens
  misc_feature 288: n = A,T,C or G
gggcctgcactaccatggctcccgaagttttgccaaaacctcggatgcgtggccttctgccaggcgcggcgacatcatatgagctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagttgncactgcttgtgttcctgaactatgacacatgaatatgtgggctaagaaatagttcctcttgataaataaacaattaacaaataaa

SEQ ID NO: 52685 - DNA, 406 bp, Homo sapiens
ctcctggatgccttaaaaaataagctatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgtgacagcttggaagcgttatttatacatctctgtaaaaggatattttagaattgagttgtgtgaagatgtcaaaaaaagattttagaaggcaatatttatagggtattggt

SEQ ID NO: 52686 - DNA, 387 bp, Homo sapiens
  misc_feature 60, 111, 272: n = A,T,C or G
gatccgattaagccttttcttctgccttgcttgcttgatcttcagcggaattcgaaatgngctggccggtaaggctggaaaggactccggaaaggccaagacaaaggcggnttcccgcttcgcaagagagccggcttgcagttcccaagtgggccgtattcatcgacacctaaaatctaggacgaccagtcatggacgtgtggccgcgactgccgctgtgtacagcgcagccatcctggagtacctcaccgcagaggtacttgaactggcanggaaatgcatcaaaagacttaaaaggtaaagcgtattaccccttcggtcacttacaacttgctattcgtggagatgaaagaattggattctctcggtcaaggctacaattgctgg

SEQ ID NO: 52687 - DNA, 412 bp, Homo sapiens
  misc_feature 30, 193, 344: n = A,T,C or G
tttggaaattattctgaataggaatttagnaactgaactctctgtcgcttttttttttcccaggtgcagtacagaaggtttctaaaaaattagaaatgcacgtttacagcaagaggttggagatcatgctccaggacatatttggagaagactgtgtaagtgtaaaggatgactctattcttagcgtcacagnggacgggaaaactgccaaccttaacttggagacacggactgtagaatgtgaagagggaagtgaagacgatgaatccctccgagaaatgggggagctgctgcacagagactgtacgaggccctgacgccagttcactgagactgcgcctgtntatgaactttgaaaaaatacttggctctcttttggtacctaaaataaaatgcattcgtttctcaaaaa

SEQ ID NO: 52688 - DNA, 359 bp, Homo sapiens
  misc_feature 29, 62, 302: n = A,T,C or G
ctctagtaataactcttcctgctattcanaataagtagggagaatgaaaactgcagcatatnagacagcaatttaacagcttgaaacatctacagatagttcctactaaaagaagtggcctgcagaagtttaataatttgacttttttctaatattttaacattaacttctaaagaagttttttctaagaaaatgtttcaaggcaatattttttttgaggctgcgaagacaaatgacaggattatgagtatacagtgtatgccttttccttcatgcagaattttgaaatgttttcagtttgnatattgcatattcacatgatcattgctcactatttatgaactggccttctcaatgtt

SEQ ID NO: 52689 - DNA, 134 bp, Homo sapiens
  misc_feature 29: n = A,T,C or G
ctttgtgcaagtgcttggttttagccatnctcatttcaagtattatagacatatgtaatggtgaaaatatatgaactgtggcctttttcattcttgttacttgtgatgcaattaagtgaagataagaaaaaaaa

SEQ ID NO: 52690 - DNA, 385 bp, Homo sapiens
  misc_feature 16, 363: n = A,T,C or G
tgaaagtctctgcagngcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctnctcttctatgctttggaatact

SEQ ID NO: 52691 - DNA, 401 bp, Homo sapiens
  misc_feature 206: n = A,T,C or G
tctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttggntttttaaaaactgattatttatggccgtgacactgttaccagaaaagtaattctaattaagttattatgcaaagtcatctataagtagcatctgggaagaggagatcgaggccacagttgctattttagtatgaaaggaggatctgttggggaacatagatggcttcccctcaaatgaggggaaaaaaaaagacc

SEQ ID NO: 52692 - DNA, 372 bp, Homo sapiens
  misc_feature 345, 357: n = A,T,C or G
aatgaagtatattatgaatgtttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctggtgggatgctagaatatgggcttggaacctaatacaaatatattactaggaaaatgtgatttttttaaatgccaggaaaattggatattagnggatgaattagncatattttaaaacat

SEQ ID NO: 52693 - DNA, 190 bp, Homo sapiens
  misc_feature 24, 165, 167: n = A,T,C or G
tatcgaacacgcacggctgtgagnctacctattgtggatattgcgccctatgacattggtggcctgatcaagaatttggggtggacgttggcctgcatgctttttataaaccaaactctatctgaaatcccaacgaagaaagttaagctccatatgtgtgctctngntctaatcttgcaaccagtgcaag

SEQ ID NO: 52694 - DNA, 398 bp, Homo sapiens
  misc_feature 25, 106, 112, 135, 150, 210, 216, 228, 284: n = A,T,C or G
cctgaataataaagtgttgcttcantgattgctaaacatatattataggcgctttaaaactcatttcaggtcatctgtggaggcaattagtttgattacaagcatntaagcngtcacatagaaagccttccactncctagggcttagttncaaatcatgaaaactgaatgctctatacttatctatgtacacagctcaattttattattntgggangaaagctatgcntgttacaaagatcactcataatttcagaacctggttaaagccagtgtgcaattttngggcagaggacacaattttattaaaaaatttaaaatatgcatgtgtacatatatgtaggtagggactatcaaaagagatgtcaaaaccatctatttattctcattttggataca

SEQ ID NO: 52695 - DNA, 406 bp, Homo sapiens
  misc_feature 331, 376: n = A,T,C or G
aaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggcaacaataaaaaccaaattatggggctgctttgncacgctgcatagagaatgtgtggaaattaaactttgtaagcttgnatggggtggtggactttttttccttacagc

SEQ ID NO: 52696 - DNA, 255 bp, Homo sapiens
  misc_feature 134, 229: n = A,T,C or G
ttaaaaatttttccctttcaatgttgttttaattgtatttcttacttggtttttttgattgatagcacagtgataaatcataatactagacaaaattgtcttctctttcaaaccagagccatatatatgtctgnatatatgggacctactgcttctctgaggaaatgcataatctgttaatatcagacaaaatgagcaattggcagggctcataatatattccaatttnattggaattttcgatggaatggtatt

SEQ ID NO: 52697 - DNA, 149 bp, Homo sapiens
  misc_feature 18, 42, 74: n = A,T,C or G
gatggttgtcagactggnctaccatggagaccacggtttgancggtgaatcatgggttcagattccggagaggnagcctgagaaacggctaccacatccaaggaaggcagcaggcgcgcaaattacccactcccgacccggggaggtag

SEQ ID NO: 52698 - DNA, 390 bp, Homo sapiens
  misc_feature 28, 230: n = A,T,C or G
gtgttcttagctgtgctcagcgctactntctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggnctttctatctcttgtactacactgaattcacccccactgaaaaagatgagtatgccttgccgtgtgaaccatgtgactttgtcacagcccaagatagttaagtgggatcgagacatgtaagcagcatcatggaggtttgaaagatccgcatttggattgg

SEQ ID NO: 52699 - DNA, 254 bp, Homo sapiens
  misc_feature 157, 158, 178: n = A,T,C or G
agtttagacgtatggcatattctaatggtgtgaactttttatttaagaggtagctaaaatgttttcttgcagagttatgactgatcagactcagagcagatgggcagggcagtattgagtcactttaattaaattgaagcttcatttgcggaggtgnnggtagggtggtggctgcctntcttatatgtggtttatagattctcccagtggacttctcccaagatttaagtttttagagaaagtgtggggcaaga

SEQ ID NO: 52700 - DNA, 182 bp, Homo sapiens
  misc_feature 109, 122: n = A,T,C or G
gttataggcatgagccaccatctggcaacagtggcttcttgatggacatttgggttgtttccaaattttaccataatcactgctttccttttggaatgagagtcaaagngtttcatggtttntaaatgtttatatctagtaatcaatcttctaggaatctatcctaaggaaacaatcacaaa

SEQ ID NO: 52701 - DNA, 130 bp, Homo sapiens
cattatatgggccaggaaccaacaggactactgtaaataagatcctgtctctcgccaacaagaggttaccagtgaaaagagctgctgtccagtttttgaataatgcttggggaatccaaaataaaaaaaa

SEQ ID NO: 52702 - DNA, 351 bp, Homo sapiens
  misc_feature 62, 66, 217, 218, 314: n = A,T,C or G
tgagccttactgcctgccctatttctttgttttcaagtgtgcatgccaccaactgctgctanctgnagacaggatggaagggatacatgtatgtgtacatttaatggagaaaaccaatttatagatgtatcagagctctaagggattctctttcacttccttgggactcccaagcagaggaattaatagattaggagggtcttttggggggttgggnntaaattttcaggcgatagaggctaacttctcggtggccttcatgaatttcaatatatcatcttttcgctgacttatccctgtttgattctgagttnggattaataactatgttttttaacttcaacattctca

SEQ ID NO: 52703 - DNA, 288 bp, Homo sapiens
  misc_feature 125, 209, 271: n = A,T,C or G
catgaaacaaaaggaaagaactgtagatatagcacagtaatattaacagaattaccagagtgctgagaattattaaagaggacattatgtttgttaatcgggcatttaatttttcttctgtttgntgatgggaaaacatcctcttggaaaggattttctcaaaaaccttaattgtgacaatgccttcttaacatccatgaatatactgnacaagcaaaagctattttgaaatctaattaggcaaaaagatcctaatttccattttaactgnagaatggctgaccagca

SEQ ID NO: 52704 - DNA, 210 bp, Homo sapiens
  misc_feature 133, 159: n = A,T,C or G
aagtagtgaggtagtgtcagtgggaagaaaaaaacctctcaatcatcctataaaacttattgggatatattgaatattactgtatagatgtttaaaggttgaataattattctgtatatttgagatgaactgntatgatataagcaatgtaacactagntttatgtacattttgaagtaacataataatttaactcaaacccgggagcag

SEQ ID NO: 52705 - DNA, 309 bp, Homo sapiens
  misc_feature 63, 121, 125, 220: n = A,T,C or G
cccatatgtattctgtgccatactattgttaaaatgaactgttgctattgtgagatggatttnaactgacctattaagggtttctttcgaatggcactactttagggacattctagtattngctnctattggttgggccttgtggataatgtacagattaaaacaaatcttgtgctgatttgtccatttctttccctgcctttgtacatctgggatcagnctaactcatctgatttaatatgcatttaaaaaaatgccataactattaaacaccttggttacagacagatgaaataaatttattccacc

SEQ ID NO: 52706 - DNA, 182 bp, Homo sapiens
  misc_feature 108, 112, 161: n = A,T,C or G
ccaagtggaaatgaaatgtctgtgactggccacacgtgcatagaggctagggaggccaggaaacagcctcagtggccagaggatcaccagtgcatccttcatcacagnatgngcaatatgccaagattaccctcggcattcctgtcaacaaggggcaatgncataaatgtcacaataaaaca

SEQ ID NO: 52707 - DNA, 169 bp, Homo sapiens
attacctgggttggttaaatctagacttaagagctctgctcctcagaagttggacttctgaaaaatgctgacgagacaaagaatcagaagaagaaatgtgactttgatgagcttccagtttttctagataaaccttttcttttttacattggtcttgggtttgggttct

SEQ ID NO: 52708 - DNA, 135 bp, Homo sapiens
  misc_feature 51, 69, 98, 120: n = A,T,C or G
cacaggctgagaactcgttcacctccaagcatttcatgaaaaagctgcttnttattaatcatacaaacnctcaccatgatgtgaagagtttcacaaanccttcaaaataaaaagtaatgnttataaccaaagctg

SEQ ID NO: 52709 - DNA, 235 bp, Homo sapiens
  misc_feature 52, 86, 125: n = A,T,C or G
gctcaataacttagcttgtttgacaaagctcctatgataaactctgtaaggnagttccaactataaacttataccccagctgtggnctctgagagactgaagatcgaggctcctggcagggcagnccttcaggagctccttagtaaaggacttatcaaactggttcaaagcacagagctcaagtaatttacaccagaaataccaagggtggagatgctccagctgctggtgaaga

SEQ ID NO: 52710 - DNA, 271 bp, Homo sapiens
  misc_feature 48, 49, 242: n = A,T,C or G
aaactctatgctgatatcccaacaaaaaaaatttaactccatatgtgnncctcttgttctaatcttgtcaaccagtgcaagtgaccgacaaaattccagttatttatttccaaaatgtttggaaacagtataatttgacaaagaaaaatgatacttctctttttttgctgtccaccaaatacaattcaaatgctttttggtttatttttttaccaattccaatttcaaaatggctcaatggngctataataaataaacttcaacactcttt

SEQ ID NO: 52711 - DNA, 250 bp, Homo sapiens
gagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgattgacaaaaaaaaa

SEQ ID NO: 52712 - DNA, 207 bp, Homo sapiens
ccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttctttttttaactgaaagctgaatccttccatttcttctgcacatctacttgcttaaattg

SEQ ID NO: 52713 - DNA, 105 bp, Homo sapiens
aatgtactatgaagcatttccaccactttctgagaaaccagtttgcctgcaagaaatcatgactgtgtgggaacaaggctaaagtctgttcttactctagctctt

SEQ ID NO: 52714 - DNA, 227 bp, Homo sapiens
  misc_feature 111, 136, 153: n = A,T,C or G
gatgtgactacagcctgccccttactgtgttgcccagggctgatgctgtacaggttcaggctggagattttcacataggttaagattctcactcacgggactagttaggcnttaagcaccctagaggactagggtnatctgacttctcacttnctaaggtcccttctatatctcaaggtagaaatgtctatgttttctactccaattcataaatctattcataagtc

SEQ ID NO: 52715 - DNA, 105 bp, Homo sapiens
gcttgtccctgactttatttggctgcgcctggcgagcgactgagtcgtccgttgaggaaaaagaggcgaggcttttgcgagatcgtcccagcgatggcgcttcgg

SEQ ID NO: 52716 - DNA, 225 bp, Homo sapiens
aagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctg

SEQ ID NO: 52717 - DNA, 154 bp, Homo sapiens
agggaacagcgaagccttaactttaaatgacatttgtattctcagacactgagtagcataaaaaccacatagaactgagctggaacttaaattccaaactatgactactacattccaaagaaacaggtgaattaaacattttcataaaatagaa

SEQ ID NO: 52718 - DNA, 309 bp, Homo sapiens
aggccatagactcatctcccagcacaaatgggcattctatgaaatggtactggccctaggaggacctcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaaggttccctcttgctgctaatagaagcttactttttgctatatcaagcatttgtacag

SEQ ID NO: 52719 - DNA, 275 bp, Homo sapiens
gccggctgattggcacatggcatttactgggatgcccgtcggcagatgatctacagtgcagccagagcgatagcgggcatgtataaacagcgcctgccacccaggacagtgtgagaggagcctacctgggagactgagaccttccccacttttagcttgatggtaaagaagtgggtggaccttcctaaacgaatagtctaaatgaatccaggaggttttatcattttcctggagcctgcaattttcttccctagaaaggcatcatgcattccagg

SEQ ID NO: 52720 - DNA, 143 bp, Homo sapiens
acttttcagagtatatgtgtttcattgagaagcaaaattgtaactcagatttgtgatgccaggaacatgagcaaactgaaaattactatgcacttgtcagaaacaataaatgcaacttgttgtgctcttaaaaaaaaaaaaaa

SEQ ID NO: 52721 - DNA, 201 bp, Homo sapiens
aggaataagctctagttcttaacaaccgacactcctacaagatttagaaaaaagtttacaacataatctagtttacagaaaaatcttgtgctagaatactttttaaaaggtattttgaataccattaaaactgcttttttttttttccagcaagtatccaaccaacttggtctgcttcaataaatctttggaaaaccccaa

SEQ ID NO: 52722 - DNA, 147 bp, Homo sapiens
agccgggtgacgtgtgcctcaactgtcccgattcagagaacagagtcatgtaatggctcagaggattcctccacccacttacacacacacacacacacacacacacacacacacacacacacacacgcggaaaaaaaaaaaaaaaag

SEQ ID NO: 52723 - DNA, 446 bp, Homo sapiens
aacttcgtgctgccatgaagggccttggatctgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaagggggacagacgtaaacgtgttcaataccatccttaccaccagaagctatccacaacttcgcaagagtgttcagaaatacaccaagtacagtaagcatgacatgaacaaaagttctggacctggagttgaaaggtgacatttgagaaatgccttacaagctatcgggaag

SEQ ID NO: 52724 - DNA, 430 bp, Homo sapiens
  misc_feature 21, 166, 272, 403: n = A,T,C or G
taatgctggatcacagacagntcattttctcagttttttggtatttaaaccattgcattgcagtagcatcattttaaaaaatgcacctccctatttatttatttttggctagggagtttatccctttttcgaattatttttaagaagatgccaatataatttttgnaagaaggcagtaacctttcatcatgatcataggcagttgaaaaatttttacaccttttttttcacattttacataaataataatgcttttgccagcagtacgtggnagccacaattgccaatatattttcttaaaaaataccagcagtactcatggaatatattctgcggttataaaactaggttttaagaagaaattttttttggcctatgaaatgttaaacctggacatgacatngtaatcatataataaaggatccttaaa

SEQ ID NO: 52725 - DNA, 220 bp, Homo sapiens
  misc_feature 17, 19: n = A,T,C or G
agcctaggtaacgcatntnttaaacgcagacgaaaatggaaagattaattggtagtggtaggatgaaacaatttggagaagatagaagcttgaagtggaaaactggaagacagaagtacgggaaggcgaagaaaagaatagagaagatagggaaattagaagataaaaacatacttttagaagaaaaaagataaatttaaacctgcaaaaaaaaaaaaaa

SEQ ID NO: 52726 - DNA, 244 bp, Homo sapiens
  misc_feature 163: n = A,T,C or G
tgtttagcttttgcagagatcataccccagaaccaaaaggccattgctagttccctgaaatcctggaatgagaccctcacctccaggttggctgctttacctgagaatccaccagctatcgactgggcttactacaaggccaatgtggcaaggctggcttggnggatgactttgagaagaagtttaatgcgctgaaggttcccgtgccagaggataaatatactgcccaggtggatgccggaaa

SEQ ID NO: 52727 - DNA, 313 bp, Homo sapiens
taaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaccctt

SEQ ID NO: 52728 - DNA, 353 bp, Homo sapiens
  misc_feature 37, 230, 287: n = A,T,C or G
ctgcatttcatcctgtgcgacagagcaacctcctccngtcttaaacaaaaaacaaccagctgagtgtggtggctcatgcctgtgaccccagcactctggaggctgaggcacgcagattgcttaactccaggagttcaagaccaacctgggcaacatggcaaaaccccatctctacaaaaaatacaaaaattacccgagcatggtgacatgtacctgtagtcccagctacnggggaggctgagatgggaggatcacctgagctgagccccagaggtcaaggctgcggngatccaagatcatatcactgcactccagcctgggtgcaaaatgagacactctctcaaaccaaaaca

SEQ ID NO: 52729 - DNA, 420 bp, Homo sapiens
  misc_feature 290, 307, 318, 338: n = A,T,C or G
taagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaagtgnctggcccgcaatactgnaggaccaagcngacttgtactgggatatttnaaaatcacagactcactttttccaaatgatcctaggaattgcctagaaatatctttctcttacccggtaatttatcaatttt

SEQ ID NO: 52730 - DNA, 352 bp, Homo sapiens
  misc_feature 50, 55, 253, 283: n = A,T,C or G
tgtgggacccggactcggcccgaggtgctgtagtggtaccagcagttatnttacntgggctttgacgaagcgaaatttgaagatgacatcacctattggcttaacagagatcgaaatggacatgaatactatggcgattactaccaacgtcactatgatgaagactctgcaattggccccggagcccctacggctttaggcatggagccagcgcaactacgatgactactaaccatgacttgccacacgctgnacaagaagcaaatagcgattctcttcatgnatctcctaatgccttacactacttggttctgatttgctctatttcaagcagatctttctacctactttg

SEQ ID NO: 52731 - DNA, 328 bp, Homo sapiens
  misc_feature 20: n = A,T,C or G
aatatttaaatatggggttnttagagggagaagaaggggaaaggcatggttaacttatttaacaaatgagttgctgaaaaattctcaagtcttgggagaaaatggacatgcagatttatgaagcttaatgatctccaaacaggttcaacccaaagagggccccaccaagtcatattacaataaaaatgtcagaaatcaaagacacagagagaatttaaaaagcagcaagagaaaaatgtcaaatgacatatcaggaaatctccattagactgcagcagatttatcagcagaaaccttgcgagccagaagagaagggagaaatatactt

SEQ ID NO: 52732 - DNA, 232 bp, Homo sapiens
  misc_feature 22, 24, 92, 108: n = A,T,C or G
ttacatttttactttgttcaantnatattgtatcatattaaatgaacattgcattgtgaaaataccctgcttagtcatgggtatgtaatcanccttatacctttttgnattctttttttaaatatttctgagaatttctgggctaaatttaaataggatgttgttttgtaatcatcttgtgattcttttgtctcctttgggtattattggccaatagatgaattaagaaatg

SEQ ID NO: 52733 - DNA, 400 bp, Homo sapiens
  misc_feature 169, 195, 333, 374: n = A,T,C or G
caggccaagaagcatccgagcttgatccccctctttgtatttattggaactggagctactggagcaacactgtatctcttgcgtctggcattgttcaatccagatgtttgttgggacagaaataacccagagccctgggacaaactgggtcccaatgatcaatacaagntctactcagtgaatgtggattacagnaagctgaagaaggaacgtccagatttctaaatgaaatgttcactataacgctgctttagaatgaaggcttccagaagccacatccgacaatttccacttaaccaggaaatattctcctctaaagcatgaaatcatgtnggagatctctattggaatctctattggagataccaatgatnaatcaataaaataaccggaaacctaa

SEQ ID NO: 52734 - DNA, 496 bp, Homo sapiens
ttaatgcagcaatattaaaaaaggtcattcagtgttgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaccagtggtgtgaagagaaagtgaaatgtgtgcctgacactgtaacactgtaaaggattgttccaaatctagttgcactgctctggttataattggttaatattagacaaaacaggtagacaaaatgcagcagcaaggcaatgggattagcagaatattgggcctcattgcatggg

SEQ ID NO: 52735 - DNA, 316 bp, Homo sapiens
  misc_feature 32, 65, 240, 299: n = A,T,C or G
aagctgatggttgccctggcaaagggtagatnagcagaggatggctctgtcattgattatgaacngattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaaggaaagaggntaaaggagacctggaaaatgctttcctgacctggtcaaggcatcagaacaagcccctgnattttgctgatcggctg

SEQ ID NO: 52736 - DNA, 378 bp, Homo sapiens
  misc_feature 24, 140, 261: n = A,T,C or G
ccgagatgtctcgctccgtgtttnttagctgtgctcgcagctactctctctttctggcctggaggctatccagcgtactccaaagattcaggcttactcacgtcatccagcagagaatggaaagtcaaatttcctgaatngctatgtgtctgggtttcatccatccgacattgaagttgacttactgaagaatggagagagaattgaaaaagtggagcattcagacttgctttcagcaaggactggctttctatctcttgnactacactgaatcacccccactgaaaaagatgggtatgcctgccgtgcgaaccatgtgactttgtcacagcccaagatagttaaggggatcgagacatgtaagcagcatcatggagg

SEQ ID NO: 52737 - DNA, 465 bp, Homo sapiens
  misc_feature 26, 57, 403, 428, 433: n = A,T,C or G
ttattgaggaaaattaatatcacttnataaccccaccctttacattttgtgcagtgnttattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggattttatggtttattaggcattttcaagaagacggattatctagagaataatcatatatatgcatacgtaaaaaatggaccacagtgacttattggaggtggtagttgccctgctacctaggttggtaagngcatttgagcaccatttaatttccnctaantaaaagggcggaatttcaggggcaaatatatt

SEQ ID NO: 52738 - DNA, 284 bp, Homo sapiens
  misc_feature 21: n = A,T,C or G
ttcagaattttcagatacttnggaggaagaaaggatccactacttcttgtttttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcggtaaaaaaaaaaaa

SEQ ID NO: 52739 - DNA, 176 bp, Homo sapiens
  misc_feature 116: n = A,T,C or G
gtgtgctggaaaagtgctgcctgctctgctgtcatcatgagattttctctgctcttctggaaacaaagggctcaagcacccctttcaaccctgtgactggggcctccctcggctgnaggcctggtccgcattcagtgacaaataaagccattgtgctctgaggcctgcactaccgc

SEQ ID NO: 52740 - DNA, 446 bp, Homo sapiens
  misc_feature 27, 28, 30, 62, 96, 214, 341, 345, 428: n = A,T,C or G
tgtgaaatacaaggaaatgcagtaaanntnagggaatttacaataacatttccgtttccatnattgaataagtcttattcagtcatcggtgaggtnaatgcactaatcatggattttttgaacatgttattgcagtgattctcaaattaactgtattggtgtaagatttttgtcattaagtgtttaagtgttattctgaattttctaccttagntatcattaatgtagtcctcattgaacatgtgataatctaatacctgtgaaaactgctaatcagctgcaataatatctaatatttttcatcatgccggaattaataatcatcatactctagaacttgnctgncactcactacatgaataagcaaatattggcttcaaaagaatgcccaggaaccacaattaagatggcatattattttgaaagtncaaaatatactaaaagag

SEQ ID NO: 52741 - DNA, 471 bp, Homo sapiens
  misc_feature 26, 33, 35, 70, 71, 422: n = A,T,C or G
tttacaaccctctgctttcacatctntgagctntntcctcattagtgaaggtggcttttgctttatagcnnggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctccgccagatgccatcacatccctgatactgtgtatgctttgaagcaccttccctgagaagggaagaggggatctttggactagggtcttgggtccagacctggaatccacaaaagccaaaccaagctcatttcaacaaaggagctccgatgtgaggggcaaggctgccccctgccccagggctcttcagaaagcatcttgcatgngaacaccatcatgcctttataaaggatccttatacaggaaaagcatgag

SEQ ID NO: 52742 - DNA, 518 bp, Homo sapiens
  misc_feature 29, 30, 62, 97, 290, 460, 462: n = A,T,C or G
ttcagggtgctaaaaggaaaatcaaattnnaaacaatcaaactatcaactgagaaccctatntccagcaaagctgttcttcaaaagtaaggaacagntcaaaaattaagatattcccagataaaagctgaggaagtttcttaccagtaaacctttcctgtaagaaatgctaaagggagtcctgtgagatgaaataaaagacactaaatagtaactcaaagctgaataaagaaataaagatctcagcaaaggtaaatacttgtcagttatatagtatcattgtaacatggnttaaaactctacattttggttcctacacaatttgggactaatacacttaaagaaattattacttaatgcttcgatgacagaatgtatgaagatgtgattttgtaacatagtagcagaatgaacagggtaaaaaacatgatctcaaatagaaataaaacaccaatcgaaangnaggaacagagctgctaaaagaacagaggttttggattggtattggaggtaagccgg

SEQ ID NO: 52743 - DNA, 319 bp, Homo sapiens
  misc_feature 173, 189, 206, 267: n = A,T,C or G
tacatgagataaatcatgaaggccacctatcatcctgcttttgcttgcacaagtttcctgggctggaccgtttcaacagagaggcttatttgactttatgctagaagatgaggcttctgggataggcccagaagtcctgatgaccgcgacttcgagccctccctaggcccagngtgccccttccggtgncaatgccatcttcgagnggccagtgtctgaattggggctggacaaaagtgcaaagggatctttcccctgacacaactntgctagacctgcaaaacaacaaaataaccgaaatcaaagaaggagacttaaa

SEQ ID NO: 52744 - DNA, 156 bp, Homo sapiens
  misc_feature 85, 87, 88: n = A,T,C or G
tctagaggtaatttatatcttcccccaggtggagcaacatgcgattctggtggcacgggggtaactgaaagtgagtacatatagncnntctggtttctggagataacccatcaataaaagctgcttcctctggtaaaaaaaaaaaaggaaaaaaaa

SEQ ID NO: 52745 - DNA, 179 bp, Homo sapiens
  misc_feature 34, 63, 68, 74, 86, 100: n = A,T,C or G
tttaatgtaaaatattctacatgtcattcagatnttatgtatatcttctagcctttattctgnacttncaatgnacatatttctgncttgcgtgatttgnatatttcactggtttaaaaaacaaacatcgaaaggcttatgccaaatggaagatagaatataaaataaaacgttacttg

SEQ ID NO: 52746 - DNA, 490 bp, Homo sapiens
  misc_feature 24, 59, 94, 135, 268, 275, 333, 363: n = A,T,C or G
ctccttcccccgctcccccaaaantttgaatttttttttcaacactcttacacctgttntggaaaatgtcaacctttgtaagaaaaccaaaacnaaaattgaaaaataaaaaccataaacatttgcaccacttgnggcttttgaatatcttccacagagggaagtttaaaacccaaacttccaaaggtttaaactacctcaaaacactttcccatgagtgtgatccacattgttaggtgctgcctagacagagatgaactgaggcctnggtttgnttggtcataatacaaagggctaattaatagtatttcagatcttgaagaatgttgatgngctagaagaatttgagaagaaatctcctgnattgagtggatcggggggggattttttaaaaaattggattaagcattcatatttccatctaattcccaattaaaggatgcggattattggccaaacttcttcagatcagcatttggtcttggcagct

SEQ ID NO: 52747 - DNA, 486 bp, Homo sapiens
  misc_feature 22, 53, 90, 300, 363, 402, 464: n = A,T,C or G
tcacgcgatggatgtggatttnccgagcggcaccaacagcggcgcgggcaagntgcgctttgaagtgaaaaagtggaatgcagtagcccnctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttcactgcatctctcgctgctcaaaacacgacaggtgtgtccattggacaacagagagtgggaantccaaaagtatggcctaggaaaagactcttccatcaagcttaattggtttggtatcatttaangactttccctgctgtacctaaatacaaattggatggacnggggtttttccgctttggtttcaagttggcggttctggagccatatggattctgggcaaaanaaagccagttggattctggaaa

SEQ ID NO: 52748 - DNA, 158 bp, Homo sapiens
tctgattaaattggcagaagaacgtttacagaagaaggaaacttaagatgtgcaaggtgatttaatgatttcaaagaaaataatgggcctttgccttaatgttaaccttttttaaatacaatactgatagttaggaagaaaactattgtactcttttg

SEQ ID NO: 52749 - DNA, 335 bp, Homo sapiens
  misc_feature 25, 32, 66, 274, 297, 310: n = A,T,C or G
aaagtgacccaaacacttctgcttncactttngttgtctggcccgcaatactgtaggaacaagcangatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggataattatggtgggtgattattttttatactgnatgtgccaaagctttactactgnggaaagacactgntttaataaaagattacattccaaaa

SEQ ID NO: 52750 - DNA, 290 bp, Homo sapiens
  misc_feature 25, 47, 194, 209: n = A,T,C or G
tgcgacctaaaactctggtgctttncctgccttcttttgctcccagngaagatcaagccaccacttcaagtgatttggatacacaggaagaattcactggggctaccagaggttggaaggtgggaaaagggagaggagcagaaagaataactattgggtactaggcttggtacctgggggacaaaataatctgnacatcaaccccccgngacatgagtttacttatgtggcagacctgcacatgtacacctgaagctaaaataaaagtaaaaaataaaaataaataagcc

SEQ ID NO: 52751 - DNA, 275 bp, Homo sapiens
  misc_feature 18, 51, 87: n = A,T,C or G
ctgccaccccactcttanttagtggtggaagaacgggctcagaactgtttntttcaattggccatttaagtttagtagtaaaagacnggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgcacagaattttgagacccattaaaaaagttaaatgag

SEQ ID NO: 52752 - DNA, 265 bp, Homo sapiens
  misc_feature 34, 63, 65, 66, 77, 83: n = A,T,C or G
tgaggcgtgcagcatatcatggagaacttacttnagattgtgcgggaccactggggtcatgtncnngcccctatggnatttgncattggatgttatttagacagaaagagtgatgaacggctaactgccttccggaacaagagtatgttatttaaaagggaattgcaacccagtgaagaagttacctggaagtaaagactggctagattatcgaatggtcacattttaaagtctgagagaaataaaaacatgaagaatctaacac

SEQ ID NO: 52753 - DNA, 336 bp, Homo sapiens
  misc_feature 18, 204, 227, 261, 307: n = A,T,C or G
gccgagatgtctcgctcnttggccttagctgtgctcgcgctactctctctttctggcctggaggctatccagcgtactccaaagacccaggtttactcacgtcatccagcagagaatggaaagtcaaatttcctgaattgctatgtgtctgggtttcatccatccgacattgaagttgacttactgaagaatggagagagaatngaaaaagtggagcattcagactngtctttcagcaaggactggctttctatctcttgnactacactgaattcaccccactgaaaaagatgaagtatgcctgcgngggaccatgggactttgcacagcccaaga

SEQ ID NO: 52754 - DNA, 387 bp, Homo sapiens
  misc_feature 19, 52, 56, 177, 249, 278: n = A,T,C or G
tctactataggaaccactnttgaagaactagttctacaattcagctgtatgnccgnaaaggagtcaagtcaatgaaggagttataaagagttgctgaaaaatggagtaacagtgtatgggacttcacatcagttctccttattgattgttagtttaatccctcttgtcttttgttgnaaacattttctataattaggaaatgccatttaagagtgagagaggatatatctatgagccattgggttgggngtttacaagaactttaccatactgggggnagtccattctgacagttaaaaagtgatcacgatttgcagctttttatcagatcacaaaaaaacagtctttaagcattgcttgggaagggttcttaagatagggttataa

SEQ ID NO: 52755 - DNA, 254 bp, Homo sapiens
  misc_feature 26, 60: n = A,T,C or G
cagaagtcgacctgaggcaaatgttnctaccctgccaagcgcaagagaaagtataactgnagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 52756 - DNA, 400 bp, Homo sapiens
  misc_feature 18, 235, 266, 310: n = A,T,C or G
cctataggatcttggctnttgggcatactaggggaacacataatccctgtgtatttgggatggtggtatccagctggatgtcaggccgaacttttcctgctaccaccagttttaccatggttagggactcttctctgtattctagtagcaaagagcttttaacttattacagatgacttatctctgagtcttctcttttgaggttcattcctattgcatctagcaactgagttgnaggttaaggaaataaggccacttgatacttnctatcaataaagagtacctgggaaagagtaatcaagcttatgcnatatgggggggaattggtaaatctggaatccagacaaatcttggaccctaccaacatatgaaaataggggaatatagaattaaatccagg

SEQ ID NO: 52757 - DNA, 228 bp, Homo sapiens
  misc_feature 50, 56, 79, 148, 152: n = A,T,C or G
tccaagtatcctgacaagcactttttagctggctagctatgggatgatgnagaagngcattcaagagctagtttttggnaagtcctgtaccaagattaacccagctgtgtcagtttataaatgtatttgtgtatagggtgtgtagtanatanggcaagggttttttccccccacttaagtgattatttttgggcacatctaggaaaaccggcagcatggttctatcca

SEQ ID NO: 52758 - DNA, 297 bp, Homo sapiens
  misc_feature 53, 97, 130, 148, 163, 248, 260: n = A,T,C or G
ctttccaatcagctgcgttttggagccacgctttcgggggttgcaagatggtntccacccagtggaactgatgagccggtttccggggagctggtgnctgtggcacatgcgctttctctcccagcagagncgtatggcaaccgatccngacattgagatggcntggccatgagagcaatgcagcatgctgaagtctattacaagctgatttcatcaggtgacctacagttcctgaaactcaccaaagnagatgaccaaanttactctgagtccggaaaaattttgagacccttagga

SEQ ID NO: 52759 - DNA, 443 bp, Homo sapiens
  misc_feature 58, 363, 402: n = A,T,C or G
gaggttgtagaagagaagaagatttaggttcctgctgtgccagaaacccttaagattnagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtatagaactgaaattcgaatggcgaggatggcaagaaaagctggcaacttctatgtacctgcagaacccaaattggcgtttgcatcagaatcagaggtatcaatggagtgagcccaaaggttcgaaaggtgttgcagcttcttcgccttcgcaaatcttcaatggaacctttgngaagctcaacaaggcttcgattaacatgctgaggattgnaagagccatatattggatggggggaccccaatctgaagcag

SEQ ID NO: 52760 - DNA, 310 bp, Homo sapiens
  misc_feature 41, 42, 244, 255: n = A,T,C or G
cagagtctcaacagtctctgcaatggagtgtgggtccaccnnagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcggggcanggaaaaatggnctctgcggaagctttcaagggtttttggaggcttttggaaattgggataggactt

SEQ ID NO: 52761 - DNA, 366 bp, Homo sapiens
  misc_feature 30, 31, 65, 66, 173, 252, 279, 324: n = A,T,C or G
attctttatcacctgacaccaggagttttnnttggaaaaggatttgaacctggtgttactaacannttaaagaccacacaaggaagcaaaatctttctgaaagaagtaaatgatacacttctggtgaatgaattgaaatcaaaagaatctgacatcatgacaacaaatggtgnaattcatgttggagataaactcctctatccagcagacacacctgtggaaatgatcaactgctggaaatacttaataaantaatcaaatacatccaaattaagttgntcgggggtagcccttcaaagaaatccccgggactgctatccactnaaattataaccaaggtggggaccaaaaataaagggatggagg

SEQ ID NO: 52762 - DNA, 257 bp, Homo sapiens
gaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttggaaaaaaaa

SEQ ID NO: 52763 - DNA, 181 bp, Homo sapiens
  misc_feature 26, 50: n = A,T,C or G
gagaaatgagttctgcaaggctgatnttacagaccaatattataaaaatnagtcacgtttctaaaacaatgaacaatatgaaaatgaaattaagaaaacgattccatttataatcacatcaaaagaataagcttaggaataaattcaatcaaagaagtacacaacttgaacactaaaaact

SEQ ID NO: 52764 - DNA, 398 bp, Homo sapiens
  misc_feature 32, 104, 202, 327, 376: n = A,T,C or G
cccatgtgtattgatggcaggagctgttgccntttaagcgccttttatttagggtaaaattaacagtttccattctattcctctgacccatgcttagtacatangacctttaacccttacatttatatgattctggggttgcttcagaagtgttatttcatgaatcattcatatgatttgatcccccaggattctattttgnttaatgggcttttctactaaaagcataaaatactgaggctgatttaagcagggcaaaaccatttactttacatattcgttttcaatacttgctgtcatgtacacaagcttcttacggtttcttgnaacaataaatatttggggtaaataatgggtacattttaacaaactcagnagtacacctaactggataaaag

SEQ ID NO: 52765 - DNA, 371 bp, Homo sapiens
  misc_feature 42, 76, 297: n = A,T,C or G
gcagtggttttatttcagctcactgcaacctctgcctcctgngttcaagcaattctcctgtctcagcctcccaagnagctgggactacaggcacatgccatgatacccagctaatttttgtatttttattagagatggggttttaccatattggtcaggctggtctcaaactcctgacctcaggtaatccacccgccttggcctcccaaagttctgggattataggcgtgagccagtgtgcctggcaatgaagtatcttacaagctgggagaaataaagaagttatgcccgcatggnaaatatgcaataaaggcatttggtattttctctagagaagcgcataaagataaaatagttattgaattctcaaa

SEQ ID NO: 52766 - DNA, 114 bp, Homo sapiens
gaaaagaaacagggaagacggagacaccctttggtggtcctctctgagtcaaatccagtggaggccaattgtacaataaattttttttggtccggtgaaacaaaacagaaaaaa

SEQ ID NO: 52767 - DNA, 247 bp, Homo sapiens
ttttttgtatgattgtcataagggttttagcatgtccctccttttcttcaccctccccttttttcttctattaatcaagagaaacttcaaagttaatgggatggtcggatctcacagactgagaactcgttcacctccaagcatttcatgaaaaagctgcttcttattaatcatacaaactctcaccatgatgtgaagagtttcacaaatccttcaaaataaaaagtaatgacttagaaaaaaaaaa

SEQ ID NO: 52768 - DNA, 106 bp, Homo sapiens
gggctcagactccccaaagggccatttaacctatgggagtgtcgggccttctgaggttctgaaatgtctcttttgtagaaaacagctaataccctctgagaagaaa

SEQ ID NO: 52769 - DNA, 224 bp, Homo sapiens
  misc_feature 91: n = A,T,C or G
tttgatttctaagcattgctcttataacaaatgctattgataatagtaattttattttttttaaactactgatttccagttgttcaatgcnagtatacagaaatatgattgatatttgtgtattaactttatattctgtgtgtgactgtgctaattcacttttaatttctaggagcttatttgtacattctgtggaattttgtacatattaaatcataaatggg

SEQ ID NO: 52770 - DNA, 317 bp, Homo sapiens
  misc_feature 144, 273, 292: n = A,T,C or G
cggctactctctctttctgttctggaggctatccagcgtactccaaagattcaggcttactcacgtcatccagcagagaatggaaagtcaaatttcctgaattgctatgtgctgggtttcatccatccgacattgaagttgacntactgaagaatggagagagaattgaaaaagtggagcattcagacttgtctttcagcaaggactggggctttctatctcttggactacactgaattcacccccactgaaaaagatgagtatgcctgccgngtgaaccatgtgactttgncacagcccaagatagttaaggggga

SEQ ID NO: 52771 - DNA, 384 bp, Homo sapiens
  misc_feature 54: n = A,T,C or G
catgggcattgcccagaatttcaggagttagcacaccagctctacagataagtnaacattgaaattcaaagattaaggccaaaaatatctcacttgcaattttaatattttcatttggatttatataaatgaaacatatatatgttttggaatggccagagtgaggcaaaggggatccctggaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagaagtttgcagtgagctgagattgtgccactgcctccagtctgtgtgacagaatgagacctg

SEQ ID NO: 52772 - DNA, 175 bp, Homo sapiens
agtttatgatgggaaccttaatatataatgttgccagcgattttagttcaatatttgttactgttacctatctgctgtatatggaattcttttaattcaaacgctgaaaacgaatcagcatttagtcttgccaggcacacccaataatcagtcatgtgtaatatgcacaagtttg

SEQ ID NO: 52773 - DNA, 108 bp, Homo sapiens
gcaaaaaaggttttccttactatgggaggaagtctctggctttcaaaaagtcatgctttttttttgggcacgtatggaaattaagcactaaggtaaaaccaaaaaaaa

SEQ ID NO: 52774 - DNA, 217 bp, Homo sapiens
  misc_feature 196: n = A,T,C or G
aaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtggcttccttgntcttactttaaaaagcatgtg

SEQ ID NO: 52775 - DNA, 455 bp, Homo sapiens
  misc_feature 30, 209, 241, 294, 373: n = A,T,C or G
acttgagaaggttgacataaagagcttctnttagatcctggggccattaccctactccaagatcaagcatttgcgtttggatggcaatcgcatctcagaaaccagtcttccaccggatatgtatgaatgtctacgtgttactaacgaagtcactcttaattaatatctgtatcctggaacaatattttatggttatgtttttctgtggncagttttcatagtatccatattttattactgnttattacttccatgaattttaaaatctgagggaaatgtttgtaaacatttatnttttttaaagaaaagatgaaaggcagcctatttcatcacaagacccacacatatacacgaatagacatcaaactcaaangcttatttggaaattaggggttttttaattctaccggcaaatgagggcaaaacctttactggtgcatgggaatcaagccagg

SEQ ID NO: 52776 - DNA, 157 bp, Homo sapiens
  misc_feature 22, 76: n = A,T,C or G
gagcaagcctgctttaaagatnggagaagagcttctggcaccagaaccccgcttcctccagttctcaacatggtgntgctcttcagttataccggaacgctgaatcaaaaaagtatttttaaatatccatgatttccccctgtattgaggctagccc

SEQ ID NO: 52777 - DNA, 394 bp, Homo sapiens
  misc_feature 30, 32: n = A,T,C or G
gactgctagagccgagcgaagcgatgcctntntcaaaggaacttgtttcttcaagctcttctggcagccgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacggtagtggtcgcgattttaaaggcaaagtgctaattgatattagagaatattggatggatcctgaaggtgaaatgaaaccaggaagaaaaggtatttctttaaatccagaacaatggagccagcttgaaggaccagattctgacattgatgatgcag

SEQ ID NO: 52778 - DNA, 125 bp, Homo sapiens
gtttgtttcttcatgcctttacttactttgtcccatgctactgattggcaccgtggcccccacaatggcacaataaagcccctttgtgaaactgttctttaaatgaaacacacaaaaaaaaaaaa

SEQ ID NO: 52779 - DNA, 335 bp, Homo sapiens
  misc_feature 206, 304, 318: n = A,T,C or G
gtggactgtgggtaaatggagacccacctttgacagaaagaacttatggatgctataacaaaagacaccaaactatatttacaggaacaagagttgaatgctcgagcccgggccctccaagctgcatctgcttcatgttcatttcggcccaatggatttgatgacaacgacccaccaggaagctgtggccaactggtggagggggnggaggaggatttaatacagttggcagactcgtattttgatcctgagagagccaaaatgcactggcacgaaacggctaatactatgactggtaaaaggnagactataacaaanatctatcttttattttt

SEQ ID NO: 52780 - DNA, 103 bp, Homo sapiens
gcacacgcacgggtgtttctgtgtgctagttgcttcttgctgctgcttcctgcttgtctgggactcacatacataacgggatatatatatatatatataaatg

SEQ ID NO: 52781 - DNA, 234 bp, Homo sapiens
  misc_feature 28, 37, 179, 202: n = A,T,C or G
tttataaaggcatgaatcccattcatgnggccctgcnctcataaattatggcataattacttctcaaaggctctacctcccaataccatcactttaggaggtaggatttcaacataccaattttgggaggcagggcacaaacattcagccataacaatgccattttgcaacttgaaagnttaactgggggaatatggtgccnggttaaaacattggtagggtaattgaaaaaaa

SEQ ID NO: 52782 - DNA, 371 bp, Homo sapiens
  misc_feature 219, 242, 264: n = A,T,C or G
atccacctgcctcagcctgccaatttgctgggatcataggcgtgagccactgtgcccaaccagtaggtgtatatatttatggggtacatgaggtattgtgatataggcttatgatgtataataatcatatcagtgtaaatggggtatccatcaccacaaacatttatcctttctttgggtacaaataacctaattatacttttagttactttaaaatgnacaatattattgctgcctatagncacccttctggggaatagcagnaatcttcaaaccagttggctttaagggttttaaaataaataccaaaatagacaactactagctgcataatatgaaaaaaagggggaatccaatccccaaataaggaa

SEQ ID NO: 52783 - DNA, 137 bp, Homo sapiens
attgcttagcgttaagtttttaacgtaattttaatagcttaagattttaagagaaaagatgaagacttagaagagtagcatgaggaaggaaaagataaaagggttctaaaacatgacggagggtgagatgaagctct

SEQ ID NO: 52784 - DNA, 427 bp, Homo sapiens
  misc_feature 30, 336, 403: n = A,T,C or G
gtttatgttggcatagcaaaaggaaatggntttctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagtctaccagaacatgatccaatacgtgaccaaagttggtatgtgaacaaaaagctccgcaaaggctgcttggaagaatatggagtcagaacctgtactcttatcagttccttggggatgctattgntttgccagcgggagcacttcatcaggtcagaattttcacagctggattcaaggtaactgaagatttngggtctccagaacatctggaagag

SEQ ID NO: 52785 - DNA, 167 bp, Homo sapiens
  misc_feature 30, 67: n = A,T,C or G
aagtcatgttcaggtaaaactcgttctcgnttacctctgcagctggtggttggcactctgacaccgngctcaagtcttcctgtcctggggtttcctcatcaacccacaccatgactggacattgccaagtcactgtcccaatgacagattttatacaattcgctact

SEQ ID NO: 52786 - DNA, 234 bp, Homo sapiens
  misc_feature 14: n = A,T,C or G
cccaacttaaaatntttcgactctaccaggtgcaaagtgatatgcattcagtagaaaccataccttgagcacccatacaaccattttgttttactttcagtacagtattcaataaattgcatgagatattcaacgccttaatataaaataactctaggctaacataagtgatctgagacttttaaggtaggctagtctatgatgttcagtaggctaggtgtataaaaaaaaaaa

SEQ ID NO: 52787 - DNA, 216 bp, Homo sapiens
  misc_feature 31, 45, 56, 170, 176: n = A,T,C or G
gaggttacagattcaggaattgtagggcctnaacctatagacttngcccaaatgcnctccgacatgcagtagatgggagacaagaggagattcctgtggcatcgctgcatctgaagacaggcttgggggggcattgcagctataaacagcattcagcacaacactcgctncaatgngatttctacattgtactctcaacaatacagcagaccatct

SEQ ID NO: 52788 - DNA, 114 bp, Homo sapiens
tgcgactttataggcaggtaaattttgctattactattgaatacaaatgacaattcatttatgaccctcaacagcggtagtaaccatttcgtgacaaaggattaaacatccatc

SEQ ID NO: 52789 - DNA, 161 bp, Homo sapiens
gaaggtgaacccaaggctgaaggaaacagcaaattcacctacacagttctggaggatggttgcacgaaacacactggggaatggagcaaaacagtctccgaatatcgaacacgcaaggctgtgagactacctattgtagatattgcaccctatgacattgg

SEQ ID NO: 52790 - DNA, 210 bp, Homo sapiens
ttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttgcaaataagaattaaatgtctgctacaccgaaaaaaaaaaa

SEQ ID NO: 52791 - DNA, 436 bp, Homo sapiens
aaaatcagcagagttgatgcagctagcctgaaaggactgaataatttggctaagttgggattgagtttcaacagcatctcttctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtatgagtcttttcagcaacccggccagtactgggagatacagccatccaccttcagatgtgtctacgtgcgctctgccattcaactcggaaactataagtaattctcaagaaagccctcatttttataacctggcaaaatcttgtaatgtca

SEQ ID NO: 52792 - DNA, 310 bp, Homo sapiens
ttccatttactttccctctgtctgtgtctgtccaatcttccaccccaagaacaccaaggaaatcaatgttgtagacccagattgaatttaagatttttgaatggaaggaatgaaagcacttaggtgcattttctcttgttggaaactgattttaaaactttttattacttacgtttagggaaacatttggggttggttgcagaagggtataatatttatttatttctttgtttacaaattgaattttagtgcatatccctccttcttccaggaaggattttaagcttctaaataatacaaatcaattcag

SEQ ID NO: 52793 - DNA, 326 bp, Homo sapiens
attatgcataaagccaaatttccagtttaagtaattgcctactataaaaagaaattttgcctgccattttcagaatcatcttttgaagctttctgttgatgttaactgagctactagagatattcttatttcactaaatgtaaaatttggagtaaatatatatgtcaatatttaagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttga

SEQ ID NO: 52794 - DNA, 346 bp, Homo sapiens
aaagtatactgtgatttctctactggcgaaacctgtatccgggcccaacctgaaaacatcccagccaagaactggtataggagctccaaggacaagaaacacgtctggctaggagaaactatcaatgctgcagccagtttgaatataatgtagaaggagtgacttccaaggaaatggctacccaacttgccttcatgcgcctgctgccaactatgcctctcagaacatcacctaccactgcaagaacagcgttgcatacatggatgaggagactggcaacctgaaaaaggctgcattctacagggctctaatgatgttgaacttgttgctgagggcaacagcaggt

SEQ ID NO: 52795 - DNA, 247 bp, Homo sapiens
  misc_feature 58, 72: n = A,T,C or G
aaggaaaagcaggtgctttttaaaaatcagaactgaggtagcttagagatgtagcgangtaagtgtcgatgnttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgctg

SEQ ID NO: 52796 - DNA, 224 bp, Homo sapiens
aaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgtccacggaaacactggtggacagattctagtgctgagaagaaacacgtttggtttggagagtccatggatggtgg

SEQ ID NO: 52797 - DNA, 254 bp, Homo sapiens
ctggaataatggacgccgctggcagtccagacatcaattcaaaactgaagctgcagcaatgaagaagcagtcacatacagaaaaaagctaatcatgctctctaccaactaccatgaggctaaaagcaaagtcaacaaacccctattataccttccaccaaattctttatcattgtctttcttaggaaacagacatactcattcatttgatttaataaagttttatttttccaaatgtaaaaaaaaaaaaaaaaa

SEQ ID NO: 52798 - DNA, 161 bp, Homo sapiens
ctattattatattcatatctctacgctggaaactttctgcctcaatatttactgtgcctttgtttttgctagtttgtgttgttgaaaaaaaaaacattctctgcctgagttttaatttttgccaaagttattttaatctatacaattaaaagcttttgcct

SEQ ID NO: 52799 - DNA, 401 bp, Homo sapiens
  misc_feature 37: n = A,T,C or G
acaatttggctaagtccttatgcaaaaaaagtatgangccatttacttaatagggttgtgaggattaaatgagataattcatataaagcccatagcggaaggcctgcaggtagcaagggcccagcaaatgagagctattcacgttgccattaatgcatcatcatcgttacaattatcatctttttttttttacgttccaaagatcttccttctatctattatctcatcatatctcatctcatcatatcatatctcatcattttatccagagatacacttccttgttctttggccaaatgttcgagcttaccaagtagggagataatggagaagcagcacggctatctatacacattaatatttataaaatgctacatgtgaataatcagtacggggatcag

SEQ ID NO: 52800 - DNA, 339 bp, Homo sapiens
ggtcaccaagtctgcccagaaagctcagaaggctaaatgatatattatccctaatacctgccaccccactcttaatcagtggtggaagaacggctcagaactgtttgtttcaattggccatttaagtttagtaagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaaaaaaaa

SEQ ID NO: 52801 - DNA, 324 bp, Homo sapiens
ggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgcttcttattttacttcttttagctgtttaactttgtaagatgcaaagaggttggatcaagtttaaatgactgtgctgccc

SEQ ID NO: 52802 - DNA, 366 bp, Homo sapiens
ccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactgcttcaaggttggcatcaactaccagcctcccactgtggtgcctggtggagacctggcaaggtacagagagctgtgtgcatgcttgagcaacaccacagccattgctgaggcctgggctcgcctggaccacaagtttgacctgatgtatgccaagcgtgcctttgttcactgtaccgtgggttaaggggatggaggaagcgagtttcagaggcc

SEQ ID NO: 52803 - DNA, 320 bp, Homo sapiens
aagccataaagactcttctcaacccaattggtatagtttaaaggcaaaaatcatttcagaggaaatatggtgtttctcagaacatcagtagagattgtgccaagcttttccttaaaattttttggtaagtgtaggcaaatgggtgtaggggatggtggtgaggggggagatgggaagtttttaatcaagggatcacactgatgagtggtatgatccagaaatgtcttttctagcaccaaagttaggattaactggagaagcaagatgctggaggcaggaagaccagaaaaatagttcattgcaatagttcatgtgggaag

SEQ ID NO: 52804 - DNA, 274 bp, Homo sapiens
taactgcacatggctcaatctaataaattttcaatatagattctgatatggttataatcccaatcataccacatttaaaagctatattcctgactgtgtttctctgctagcatgacgccacaaggaaaatgaaaccaacccaaacaaaaccctccttataacagaaagtaaaatgaagcttgtaacgactgttttgaaaaatggtttgaacagtgaggaacaaccaatttttcaaacactgttgtagctgtttcaagctgtagtgtggatagtg

SEQ ID NO: 52805 - DNA, 398 bp, Homo sapiens
  misc_feature 95, 100, 103, 111, 115, 125: n = A,T,C or G
ctcaaggaaaacgacgtcataatcagcatcaatggacagtccgtggtctccgccaatgatgtcagcgacgtcattaaaagggaaagcaccctgancatgntgntccgcagnggtnatgaagatancatgatcacagtgattcccgaagaaattgacccataggcagaggcatgagctggacttcatgtttccctcaaagactctcccgtggatgacggatgaggactctggctgctggaataggacactcaagacttttgactgcattttgtttgttcagtggagactccctggccaacagaatccttcttgatagtttgcaggcaaaacaaatgtaatgttgcagatccgcaggcagaagctctgcccttctgtatcctatgtatgcagtgtgcttt

SEQ ID NO: 52806 - DNA, 127 bp, Homo sapiens
gagttctgtatgaaactgagatgttgtctatagctatgtctataaacaacctgaagacttgtgaaatcaatgtttcttttttaaaaaacaattttcaagttttttttacaataaacagttttgattc

SEQ ID NO: 52807 - DNA, 279 bp, Homo sapiens
  misc_feature 32: n = A,T,C or G
atccgccgagactatctgcactacatccgcangtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaaaaaaaaaa

SEQ ID NO: 52808 - DNA, 317 bp, Homo sapiens
attgaggcagccagcgcaggggcttctgctgagggggcaggcggagcttgaggaaaccgcagataagtttttttctctttgaaagatagagattaatacaactacttaaaaaatatagtcaataggttactaagatatcgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaagg

SEQ ID NO: 52809 - DNA, 115 bp, Homo sapiens
agcacctgtgttgtcctctttctaagccagggtcctgtctggatgacttatgcggtgggggagtgtaaaccggaacttttcatctatttgaaggcgattaaactgtgtctaatgc

SEQ ID NO: 52810 - DNA, 322 bp, Homo sapiens
aagaatattccttattttgcttttttgcatgaaatagaaaatggattgttttgatacagtgtacaggttttttttttaatcaactgaaataagaatccacttcttgctggttctgttttgttttgttttcctcatataagcagaaaacaactaacaaataatttccaaaaaggaaactattacagtgaatatggagctttaaaaaagtagcagacttcaaatgattttgggcttgacagaattaattagtgcatatttattcttaacacggtgaaagccagcacgcttccccctgtggagataaactgcttccatcattgca

SEQ ID NO: 52811 - DNA, 313 bp, Homo sapiens
ccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaag

SEQ ID NO: 52812 - DNA, 152 bp, Homo sapiens
aatttaatggtcctttaaaatgtctgtgtattaaaaatttatgaataccacactttaatattaaatattcataaggtctaagtatcttgataataatgtagatgttttaataacaatttttgtccttcttaaaataaaatgaaagaaacttg

SEQ ID NO: 52813 - DNA, 360 bp, Homo sapiens
gagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagcactattgaaatg

SEQ ID NO: 52814 - DNA, 155 bp, Homo sapiens
ctttagcgccttttctggcggcggtagatttgaagcgcttcaaaggaccggacccagagaagaggaaaactctaccggtgcaggagcacagggatcagttgtccttgtttttttttggccttttcttcatttgaagattaagtattggagccatg

SEQ ID NO: 52815 - DNA, 353 bp, Homo sapiens
ggaacagtgaaagtcaattcagtgatggcaacactgaaggaacagttaccctgctttgcctcgaaagtgtcatcaatttggaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatg

SEQ ID NO: 52816 - DNA, 248 bp, Homo sapiens
aaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaaaaa

SEQ ID NO: 52817 - DNA, 235 bp, Homo sapiens
cgtggactatggacagtcaacaatatgtacttaaaagttgcactattgcaaaacgggtgtattatccaggtactcgtacactatttttttgtactgctggcctgtaccagaaacattttcttttattggtacttgctttttaaactttgtttagccacttaaaatctgcttatggcacaatttgcctcaaaatccattccaagttgtatatttgttttccaataaaaaaattaca

SEQ ID NO: 52818 - DNA, 284 bp, Homo sapiens
actcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtggcacatgttatggcagattgaaaaggatctcattccatgggaaaaaaaaaatcctgcttgttcataaattgacaatgcaataaattgaaatatggtcactgtt

SEQ ID NO: 52819 - DNA, 283 bp, Homo sapiens
ttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggcttattttaggtgtaagcccatctgctggcaaggctaagattagaacagcccataggagagtcatgattttgaatcacccagataaaggtggatctccttacgtagc

SEQ ID NO: 52820 - DNA, 253 bp, Homo sapiens
gctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagtcatttttagattttgttgagtcctgtaaagaagaagaagaaaaaagtt

SEQ ID NO: 52821 - DNA, 330 bp, Homo sapiens
tgcaaggagagccaaagctaagacccccgaaaccagacgagctacctaagaacggctaaaagagcacacccgtctatgtagcaaaatagtgggaagatttataggtagaggcgacaaacctaccgagcctggtgatagctggttgccaagatagaatcttagttcaactttaaatttgcccacagaaccctctaaatccccttgtaaatttaactgttagtccaaagaggacagctctttggacactaggaaaaaaccttgtagagagagtaaaaaatttaacacccatagtaggcctaaaagcagccaccaattaagaaagcgtcaagc

SEQ ID NO: 52822 - DNA, 181 bp, Homo sapiens
aacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttac

SEQ ID NO: 52823 - DNA, 345 bp, Homo sapiens
  misc_feature 280, 327: n = A,T,C or G
tgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggctttctatctcttgnactacactgaattcacccccactgaaaaagatgagtatgcctgccgngtgaaccatgtgactttg

SEQ ID NO: 52824 - DNA, 351 bp, Homo sapiens
  misc_feature 33, 268: n = A,T,C or G
agtattttaaatgaagtgattctaagatttggnttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgntatttatcaatttttcccagtatttttatacggaaaaaattgtattgaaaacacttagtatgcagttgataagaggaatttgg

SEQ ID NO: 52825 - DNA, 238 bp, Homo sapiens
  misc_feature 48, 51: n = A,T,C or G
tgtagaactgaagaattcaactaatgaaataaaagctataattgaggnggncatggtggctcatgcctgtaatcaatcccagcattttgggagaccaaggcgggaggatcgcttgaacccaggagtttgagatcagcctgggcaacatggtgagacccctgtctcttgaactgtgatcatgccactgcactccagtctgggcaacagagtgagaacctgtttcaaaaaaaaaaaaaaa

SEQ ID NO: 52826 - DNA, 324 bp, Homo sapiens
atgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtgtctacatttcagaccgagttgtcagcttttttgaaaacacatcagtagaaaccaagattttaaaatgaagtgtcaagacgaaggcaaaacctgagcagtcctaaaaagattgctgt

SEQ ID NO: 52827 - DNA, 333 bp, Homo sapiens
gggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgcatacctccttctattaggaatggcatatactgaggtggtcgtaagtcttaacttctaaaattttaaataaaagactttgcacatcgaaaaaaaaaaaaaaaaaaaaa

SEQ ID NO: 52828 - DNA, 302 bp, Homo sapiens
cccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggtccatgtgtgctaaatgtgttcgggacaggatcaagcgtgttttccttatcgaggagcagaaaatcgttgggaaagtgtgaaggcacaagcacagagtcagaaagctaaataaaaaaatgaaactttttg

SEQ ID NO: 52829 - DNA, 338 bp, Homo sapiens
tcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaaaaaaaa

SEQ ID NO: 52830 - DNA, 370 bp, Homo sapiens
aaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattg

SEQ ID NO: 52831 - DNA, 140 bp, Homo sapiens
cccaggatataataaaattacacttaagaatgcagcaacccttttaaaaacatattcaacaaaaaaaaagcccctgccattttctgatatcatggtaatactcctaataaatcacaaaatatgaaaaaaaaaaaaaaaaa

SEQ ID NO: 52832 - DNA, 149 bp, Homo sapiens
atgaaccgtgaagaaaacctaaagacagctgctgatcggcaggctgaggaccaggtcctgaggaagctggtggatttggtcaaccagagagccttgctgtttacaattaaaatgtttctgccacaaacaaaaaaaaaaaaaaaaaaaaa

SEQ ID NO: 52833 - DNA, 273 bp, Homo sapiens
aaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaat

SEQ ID NO: 52834 - DNA, 269 bp, Homo sapiens
ggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgctattttatataaaatatgattaaaata

SEQ ID NO: 52835 - DNA, 405 bp, Homo sapiens
ctctcagaccacagtgcaatcaaattagaactcaggattaagaaactcactcaaaaccgcacaactacaaggaaactgaacaacctgctcccgaatgactaccggttaaataacgaaatgaaggcagaaataaagatgttctttgaaaccagtgagaacaaagatacaatgtaccagaatctctgagacacatttaaagcactgtgtagagggaaatttatagcactaaatgcccacaagagaaagcaggaaataactgaattcaacaccttaacatcaaaattaaaagaactagagaaacaagagcaaacaaattcaaaagctagcagaagacaagaaataactaagattagagcagaactgaaggagatacacgaaaaacccttcaaaaaaatcaatgaatct

SEQ ID NO: 52836 - DNA, 279 bp, Homo sapiens
  misc_feature 85, 97, 134: n = A,T,C or G
tgtgcggagacccccgggtgaagccaccgtcatcatgtctgaccagatggagtcttgctctgtggcccaggctggagtgcagtgncatgatctcggntcactgcaacctctgcctcctggttcaagtgattctnctgcctcagcgcctcgagtagctgggattacagatgaggcaaaaccttcaactgaggacttgggggataagaaggaaggtgaatatattaaactcaaagtcattggacaggatagcagtgagattcacttcaaagtgaaaatgac

SEQ ID NO: 52837 - DNA, 310 bp, Homo sapiens
aattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctggtagaaaacagaattaacaaagacagtaatgtgaagaggcattacactattcttattctttagtaacttgggtagtactg

SEQ ID NO: 52838 - DNA, 310 bp, Homo sapiens
atgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgcataaatctacgtattctcctctaccagatgactataattgcaacgtagagcttgctctgacttctgatggcaggacaatagtatgctaccacccttctgtggacattccatatgaacacacaaaacctatccctcgg

SEQ ID NO: 52839 - DNA, 334 bp, Homo sapiens
ggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtccagttattaaactctgttttgatgggatagagattgatattttggttgcaaga

SEQ ID NO: 52840 - DNA, 329 bp, Homo sapiens
cggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 52841 - DNA, 195 bp, Homo sapiens
gcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtc

SEQ ID NO: 52842 - DNA, 209 bp, Homo sapiens
atttttttaaatcatttttatctcagaacttaaacaaaaatgagatgtcgtgcacggactgtgtgaaagaagatgctttgcatatttgctgcactgcatcagtatcttactaaaaatgtgaaatgaaaggactattgtacactgaaatgcttaaatgtatctgaaagccaaggtgatactcatttttatggtcttcccatttgtgctgg

SEQ ID NO: 52843 - DNA, 383 bp, Homo sapiens
ctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacccgcaagcaaaccccctcaaaggtgacttggccaacaccttccgtggctttactcagctccagactctgatactgccacaacatgtcaactgtcctggaggaattgatgcctggaatactatcacctcttaa

SEQ ID NO: 52844 - DNA, 311 bp, Homo sapiens
caattttatagccatacaaattcatattgaagcaagtcagcaaacgtggtgcatttcagatgaaacctcaacgtgaagatatatcagttttagaccaaagcagaagtttatataaaggatataagcttttgccctgtatactcaggaattaaactaaaaagaaatctacaaattcatttatagattatttcaatttgaggcctatagatatgtgagaaaggtttctttaagggttaatgaccaagttccatgtgagctcttacttgggaaacaaaattctcacatggcattaatatactataaattgtgat

SEQ ID NO: 52845 - DNA, 322 bp, Homo sapiens
tctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagtattt

SEQ ID NO: 52846 - DNA, 317 bp, Homo sapiens
gaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtccagtcaggtggaggttgctgctaaaatttgctccatccttttctcacagcaatgaatttgcaatctga

SEQ ID NO: 52847 - DNA, 250 bp, Homo sapiens
tttgggatcaataggaaagcatatgcagccaaccaagatgcaaatgttttgaaatgatatgaccaaaattttaagtaggaaagtcacccaaacacttctgctttcacttaagtgtctggccgcaatactgtaggaacaagcatgatcttggtactgtgatattttaaatatccacagtactcactttttccaaatgatcctagtaattgcctagaaatatctttctcttacctggtatttatcaattttt

SEQ ID NO: 52848 - DNA, 414 bp, Homo sapiens
tccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattt

SEQ ID NO: 52849 - DNA, 199 bp, Homo sapiens
agcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggcc

SEQ ID NO: 52850 - DNA, 231 bp, Homo sapiens
tagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattagcttaaaaaaaaaa

SEQ ID NO: 52851 - DNA, 277 bp, Homo sapiens
  misc_feature 108, 182: n = A,T,C or G
ttatgtatataaagcaaagaacaacacagtcactcctggcggcaaaccaaacaaaaccagagtcatctggggaaaagtaactcgggcccatggaaacagtggcatggntcgtgccaaattccgaagcaatcttcctgctaaggccattggacacagaatccgagtgatgctgtacccctcanggatttaaactaacgaaaaatcaataaataaatgtggatttgtgctcttgtatttttaagtggattaaaaaacttactaccttgaaaaaaaaaaa

SEQ ID NO: 52852 - DNA, 198 bp, Homo sapiens
gggactctacctaaaatttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctt

SEQ ID NO: 52853 - DNA, 355 bp, Homo sapiens
gaggaaaaaatattaaattttgaattgagtgtgtaggctccctatcattatatatagagtttctttttccacggtagtcaggtgacttaacctgaattgtaaatgtttgtaaagggttaattgtcctacatcaaacttagttaaataattccatccacttatggaggaggaggagaatgtggaagaggtaaaaagctggcacaagttcatatgcctatgagtcagtaaagactgaagtaatgtcctatgttgagctgggtattttgatatatgataataattatctttgaagtagaacaattctgttaactggaaaatcacaggatatatccatcatatttttcaggacagatag

SEQ ID NO: 52854 - DNA, 196 bp, Homo sapiens
gccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 52855 - DNA, 174 bp, Homo sapiens
cctggagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctggg

SEQ ID NO: 52856 - DNA, 422 bp, Homo sapiens
tcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaccatgtgactttgcacagcccaagatagttaagtgggatcgagacatgtaagcagcatcatggaggtttgaagatgccgcatttgga

SEQ ID NO: 52857 - DNA, 371 bp, Homo sapiens
aaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttg

SEQ ID NO: 52858 - DNA, 379 bp, Homo sapiens
  misc_feature 180: n = A,T,C or G
gacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggntatgtttttctgtgtgtcagttttcatagtatccatattttattactgtttattacttccatgaattttaaaatctgagggaaatgttttgtaaacatttattttttttaaagaaaagatgaaaggcaggcctatttcatcccaagaacacacacatatacacgaatagacatcaaactcaatgctttatttgtaaatt

SEQ ID NO: 52859 - DNA, 259 bp, Homo sapiens
tccataatttacaccaacttcctaaacttaaaattgggttaatctataactttatagatgcaacactgttagtatgagtaacaagaattccaattctccaggcatacgcgtataacaactcggataaccattgttagttaatcagactataggcaataatcacactataaataatccacctataacttctctgttaacccaacaccggaatgcctaaaggaaagatccaaaaaaaaaaaaaaaaaaaaaaaaaaaaaaa

SEQ ID NO: 52860 - DNA, 247 bp, Homo sapiens
ttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctccttgccattttagatggaaaaataaaaaaaattaaaaagt

SEQ ID NO: 52861 - DNA, 367 bp, Homo sapiens
gaagctctcttgactatgagtaaaggagaaaaggctcgactggagattgaaccagaatgggcttaccggaaagaaaggacagcctgatgccaaaattccaccaaatgcaaaactcacttttgaagtggaattagtggatattgattgaaatagcagtgcttcagctctaaggatattagcaacaatgataaaacttggccttgaggaaatttacacaactagttagaacttgttactattgtaaaggaagagtcaactggaaaattcaaggagttaataaaatttgtttacttggcccagcttttgagagataaatcccttatgaatccctggctaaaatactttcctacagctgtgtaaaatactg

SEQ ID NO: 52862 - DNA, 144 bp, Homo sapiens
  misc_feature 39, 58, 92: n = A,T,C or G
caacctcctagtcttaacatgaatcggaggccaaccagnagaacacccatttatcatnattggcaactagcctccatcagctatttttcaantatcctcattctcataccaatctctggaattgttgaagacaaaatgttaaaa

SEQ ID NO: 52863 - DNA, 435 bp, Homo sapiens
gagacctgaggctggagaccactcccccgttccatccacttctcagcctccgttttctctgtggaaaagtccagatcccgacttatactgtctctgtcttacggattagtgtgagagtcaaatgagatcattattgccaataggctctgtcaatacatagaatttagttgaccattttcattgtcttcacttgtgggttaaataaacactaaaataaaaacatcagggagcctggctgagcagggaataacctcttggaggaaggaaaacattcccctttatatgtcagcaactttgaccctagagggaatcagaacccatgcctttggggggtggtcctgcagacacagagctgtctccccctgggaacctcaccactgctcaaaatgtaatgcaaacatgaactgacttagttatctcaatgtcaaacttaaa

SEQ ID NO: 52864 - DNA, 341 bp, Homo sapiens
aaaacttggtcctccgagatgctctatgaggagtggattccatgatgaaatgttcccctcttagagaacgaaggagcctataagcttattaataagcttattaatggctctaagaagcccttcagtaaagaaacttgcttagctttttttaatccagtatttctccaaatttacttggttataaagcctcccctcctcccatgacccagggcagttatctctgtctttgtaatactgtgtgtcatcggcttaaaaaagaaatacctgtttttggtggtggccagccacgctgggaaagagaaagagggatgattgattttctgcttcctaaaaaaaaaaaa

SEQ ID NO: 52865 - DNA, 396 bp, Homo sapiens
tctatggcaaagtctttcaaatacgagataactgcaaaatattttccttttatactacagaaatgaggatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattggaggtaaacacaaaattatcagtgttt

SEQ ID NO: 52866 - DNA, 382 bp, Homo sapiens
gccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagcgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgcattcaattagaaactgcagtaggggctgccctcaaaagttttgagaattctctagg

SEQ ID NO: 52867 - DNA, 287 bp, Homo sapiens
  misc_feature 69, 86, 89, 98, 103: n = A,T,C or G
aagtaggtcattccatcaccacccttgtctctctacacattttgcctttggggatctgggtggggcttngggttttttgttgttgntgnttatttgtnatttnaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggaa

SEQ ID NO: 52868 - DNA, 356 bp, Homo sapiens
ccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaaggg

SEQ ID NO: 52869 - DNA, 329 bp, Homo sapiens
  misc_feature 44, 53: n = A,T,C or G
ttttattcataagctaatatttttttaaagttacattaagattntttctcttntgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggggcaaaatattagctctgttttgggacattttaaaatagaactatcct

SEQ ID NO: 52870 - DNA, 392 bp, Homo sapiens
agactcagcaggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttg

SEQ ID NO: 52871 - DNA, 299 bp, Homo sapiens
gcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagcgactgatgtaaaacggttttcttg

SEQ ID NO: 52872 - DNA, 368 bp, Homo sapiens
ggaactgtagctttattagcattcactattttatagtgagaatatattcacattacttttcaaattagaactacagttttttgggccaggtgtggtggctcacacctgtaatcccagcacttggggaggccaaagcaggcagattgtttgaacccaggagttcaagaccagcctgggcaaacagggagaccctccaactctacaaataataataatgtttaaaaagttgggcatggtagtgcatgcttgttgttccagctactttggaggctgagatgggaggatggcttgagcccagtaggaccaggctgcagtgagccatgattgcaccactgcactccagcctgggcaacagagtaagactctaa

SEQ ID NO: 52873 - DNA, 339 bp, Homo sapiens
tccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagtttataatccttaaatcttaatgtcctcaaagcttggattaaatacatatggatgttactctcttgcaccaaattatcttgatacattcaaatttgtctgg

SEQ ID NO: 52874 - DNA, 394 bp, Homo sapiens
aaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatgctatattagtgctgcagaacttcgccatgtgatgacaaaccttggagagaagttaacagatgaagaagttgatgaaatg

SEQ ID NO: 52875 - DNA, 179 bp, Homo sapiens
  misc_feature 43, 70, 96: n = A,T,C or G
tgaggcagccagcgcaggggcttctgctgagggggcaggctgnagcttgaggaaaccgcagataagtttntttctctttgaaagatagagattaanacaactacttaaaaaatatagtcaataggttactaagatattgcttagcgttaagtttttaacgtaattttaatagcttaaga

SEQ ID NO: 52876 - DNA, 365 bp, Homo sapiens
tggtgggaaaggactttgaaaaaggtaggctggggtcatgttgcaaaagaccttgaatgtcagtctaaagaatttgtattggactgggcatggtggctcatgcctgtaatcccagcactttgggaggtggaggtgagcacatcacttgaggccaggagttcgggactagcctggctaacatgatgaaacaccatctctactaaaaaatacaaaaattagctgggcgtggtggcacacacctgtaatcccagctgcttgggaggctgaggcaggagaatcgcttgaatctgggaggcagaggttgcagtgagccaagattgtgccactgcactccagcctggacaacagagcaagacttcatctcg

SEQ ID NO: 52877 - DNA, 388 bp, Homo sapiens
gacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctgcccaaggtgtcctgcaggctg

SEQ ID NO: 52878 - DNA, 334 bp, Homo sapiens
ctccagagatgccttgcttaggtgaatggggagtgtaataacccaggtattgtattttaatattataatagtctactcttatgctagggtgacatacatcctggcttgtactggatgtatgtcaccatcctggcataattgttgttagtaaattgcttccccttttattccccagaagtttggatggtaaattatatggtcactatacacataacaaaaatggacttttcagtccatgggaattgtgtaacaaaagccccaaatgtaaacatatgtcattaagtaaaggtaaaatgatagtgatggggttaaaaatatcggaaatgcaaatgtt

SEQ ID NO: 52879 - DNA, 308 bp, Homo sapiens
tctgtgttaaaataatgcacaatgaataaaaatgaaaaaataaataaaatatttaaagactggaagaaaaaactattctcattttcagacaatataattatcacatactaaatcccttaaaaatgaaaaaaaaaatagttcagcagttgagcgagattgtagaatataaaatcaatctataaagtcagttgtgtttctgaatacacagtcagaaaatataattgaacataaagttttcaataacagtagcttcaaaagagctaaataaatcaaaagacatacaaagattatgtgaaggatgttgtgaa

SEQ ID NO: 52880 - DNA, 298 bp, Homo sapiens
ggttgctctagggcttactatattcattttatcagtacagtcatgtgttgcttaacgacagggatatgttctgagaaatgggtcattaggcagttttgttgtgtgaaccgtcatagtgtacttgcctaaacccagtggtatagcctactgtatacctaggctatagggtacagcctattgctcctaggctatacacctgcacagcatgttactgaatactgtaggcaactgtgacacaatggtatttgtgtatctaaacatagaaaaggtatgacaaatatggcataaaaaaaaaaaa

SEQ ID NO: 52881 - DNA, 350 bp, Homo sapiens
  misc_feature 10: n = A,T,C or G
aaaagataanaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgccatttaaagcctagttaacgcatttactaaacgcagacgaaaatggaaagattaattgggagtggta

SEQ ID NO: 52882 - DNA, 293 bp, Homo sapiens
ggggcgggcacagcagagtgcatgagccctggagttcgagaccagcctaggcaacatggcaagagcccatgtctataaaaaatacaaaaaattagccaggtgtggaagcacatgcctatattcccagctacttgggaggctgagatgggagaattgcttgaacccgggagacagaggttgtgagctgtgatcgcacctaggcggcagtgagaccctgtctcaaaacaacaaaaaaaacttccttgctttttattaatttttcactgtaggaagtttttaaaagactcaaagtt

SEQ ID NO: 52883 - DNA, 436 bp, Homo sapiens
aacttggacgctgcagaatggctcccgcaaagaagggtggcgagaagaaaaagggccgttctgccatcaacgaagtggtaacccgagaatacaccatcaacattcacaagcgcatccatggagcgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgcagatcaaataaagttataaaattgtaaaaa

SEQ ID NO: 52884 - DNA, 314 bp, Homo sapiens
  misc_feature 156: n = A,T,C or G
ttcgaggctaaagaaaatttccagcaaacacaaaatgaaaaagagtaaacacatatgcacctgataatttgttttgatgcatttatagttttgataataaaaagtactttatattgcttttctattctgttcttaactagattttttagtagtaangtgtattttgtgtgtgtgttcaaagggcaaccattctacaaaagtggaagctgtggtcagaactctgatgaaaatacagcttagagatccaggggccaaagcactcgttttctcaacggtataatcaacattttcatcctcaatattaattcgaaccg

SEQ ID NO: 52885 - DNA, 351 bp, Homo sapiens
  misc_feature 177, 270, 280, 284, 298, 304, 338: n = A,T,C or G
tgagccaagtcggcagttttgtaaaggactccattcggctggtaaaagatgcactaaacctgatagaaaagaattccagaagattgccatggcaacagcaataggatttgctataatgggattcattgcttctttgtgaaattgatccatattcctattaataacatcattgttggnggctgaatacattttggaagagagtttttcatcttagagattggtgaacaagtgtgagggtgtgagaaactcacagaatacaaatttgcctgnatgttttggngggntttttttttccttncaagangttttctatttctaaattaaaggaatttcaaagnaaaaaaaaaaaaa

SEQ ID NO: 52886 - DNA, 317 bp, Homo sapiens
tgtggtagtgatatttaatactttctgatcaaacaggttcaaagtaaaacgttaaatttcacatttcttttaaagactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggccaataattttattcactgtag

SEQ ID NO: 52887 - DNA, 145 bp, Homo sapiens
  misc_feature 62, 71, 75, 92: n = A,T,C or G
aaattcacactaaaaccagtacagtaccataagtagaatacatgtaagaatcacctagtctncactatatngagnaaatataacatgctaantttacaattaatgaaactaaactttgaaacatctccattatatctacatcctt

SEQ ID NO: 52888 - DNA, 157 bp, Homo sapiens
  misc_feature 61, 68, 96: n = A,T,C or G
gtaaactgggcaaccacaccaagtagccagaaaaaagatacttccaatcacttccatgtgnttgttgnggatttgagtccagaaattacaacagangatatcaaatcagcatttgccccctttggtaaaatatcggatgcccgggtagttaaagaca

SEQ ID NO: 52889 - DNA, 296 bp, Homo sapiens
ggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgtcaaaaaaaaaaaaaaaaaaaaaaaaaaa

SEQ ID NO: 52890 - DNA, 246 bp, Homo sapiens
tatccatttaatagaagtctaactgaaagacacccagaagtgagctcatcttagatggtgtttctgactgtgcctttctaaatggtaagtggaagagcagaagagttttgtctcagaccaaatttgtaaggaaatagactgatttatcagagagatgaggcgatgtgaaaggtcttatttctgcctgtcaaaaaggtataagacagatgtttcactaggcaggacaaagactggactcaaatatgg

SEQ ID NO: 52891 - DNA, 324 bp, Homo sapiens
  misc_feature 28: n = A,T,C or G
ccaaaaaagaaacattgttaatataatncaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatg

SEQ ID NO: 52892 - DNA, 332 bp, Homo sapiens
gaacagtggcagaaggaatatctcggtgccatttgctcctgcacatgctttggaggccagcggggctgcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagt

SEQ ID NO: 52893 - DNA, 325 bp, Homo sapiens
gtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacgggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgg

SEQ ID NO: 52894 - DNA, 314 bp, Homo sapiens
aaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacggttggccctgtttgctttttataaaccaaactctatctgaaatcccaacaaaaaaaatttaactccatatggggtcctcttggtctaatcttg

SEQ ID NO: 52895 - DNA, 245 bp, Homo sapiens
cctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttgaaaaaaaaaaaaaaaaaaa

SEQ ID NO: 52896 - DNA, 345 bp, Homo sapiens
cgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatat

SEQ ID NO: 52897 - DNA, 320 bp, Homo sapiens
agtcttgggtcataccagcatgggaacagactaatacagtaagaaggcatccctctgtaaaccaggaagtgagccagcaccttgatcttggacttcccagccttcagacctgtgagaaataaatttctgtcatttaagctacccaggctatatttttgtcatagcagcctgaattaactgagacagtgagcttaggactagctgagaaaaccagcagctttgctgcccaaaagttgtggagtgacttgattcaggctagggaagaaagagaagacacacaaactaaacctgtgactttgctggtgaaaagtggtggattt

SEQ ID NO: 52898 - DNA, 323 bp, Homo sapiens
  misc_feature 68: n = A,T,C or G
gcgccgatagcgctcacgcaagcatggttaacgtccctaaaacccgccggactttctgtaagaagtgnggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctgctattaaaagatgcaagcattttgaactgggaggagataagaagagaaagg

SEQ ID NO: 52899 - DNA, 360 bp, Homo sapiens
  misc_feature 30, 48: n = A,T,C or G
caatgttttgaaacaagatttcaaactaanctgggttgtaatacagtntataccagtgtatgctctagacttggaagatgtagtatgtttgatgtggattacctatacttatgttcgttttgatacatttttagcttctcattatagggtgattcatgctttagtgaattcttcatagatagtatatataaaagtacattttaatagaaagccagggttttaaggaatttcacatgtataaggggctccatagctttatttgtaagtaggctggataaatggtgcttaaatggtaatgtactccacttcttcctattggaagataacattatttaccaagaaggcttaagggagtaaggg

SEQ ID NO: 52900 - DNA, 219 bp, Homo sapiens
  misc_feature 50: n = A,T,C or G
aatacaagcttgccatatgaggtgatagattgagggagccttagaggatntttaagaaatgttatgagccaagcacagtggctggtgcctgtaatcccagctacttgggaggctgggatgggaggatctttgagtccagggggcttcagtatgctacgaaaacacctgtgactggcactgcactccaacctgggtaacatagtaagaccctgtctctta

SEQ ID NO: 52901 - DNA, 399 bp, Homo sapiens
tcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaagccgcgcctgcccttcccatctgtctatctatctgg

SEQ ID NO: 52902 - DNA, 310 bp, Homo sapiens
taaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataa

SEQ ID NO: 52903 - DNA, 222 bp, Homo sapiens
aggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgatttttaaatggaattttgcacataatacattgtaatactgtatgataatcatgtgtgaaaataatttttgaaatagc

SEQ ID NO: 52904 - DNA, 434 bp, Homo sapiens
tcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattaaaaaaaaaaaaa

SEQ ID NO: 52905 - DNA, 300 bp, Homo sapiens
  misc_feature 73, 215: n = A,T,C or G
atatatagatctacataaaaactgctacatgacaaaaaccacacctaaagaaattttaagaatttggcacagntactcactttgtgtaatctgaaatctagctgctgaatacgctgaagtaaatccttgttcactgaagtctttcaattgagctggttgaatactttgaaaaatgctcagttctaactaatgaaatggatttcccagtaggggtntctgcatatcacctgtatagtagttatatgcatatgtttctgtgcatgtctctacacaattgtaaggtgcactgtatttaactgt

SEQ ID NO: 52906 - DNA, 350 bp, Homo sapiens
aaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttt

SEQ ID NO: 52907 - DNA, 109 bp, Homo sapiens
  misc_feature 78: n = A,T,C or G
agtgtgcgtgcaaaatccgcttcctgagcgtagggtgctgagctggcgctagggctcggttgtgaaatacagcgtagncagcccttgcgctcagtgtagaaacccacgt

SEQ ID NO: 52908 - DNA, 319 bp, Homo sapiens
tgaaggagcaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcaaacaaaaa

SEQ ID NO: 52909 - DNA, 339 bp, Homo sapiens
gtctcattgcagataatttttagcttagggcctggtggctaggtcggttctctcctttccagtcggagacctctgccgcaaacatgctccgtcagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtt

SEQ ID NO: 52910 - DNA, 429 bp, Homo sapiens
aatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactggttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaat

SEQ ID NO: 52911 - DNA, 287 bp, Homo sapiens
aagcattgattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttggtacttgctaccctgagtactttcaggaagactgacttaaatattcggggggagtaagtagt

SEQ ID NO: 52912 - DNA, 193 bp, Homo sapiens
attttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagat

SEQ ID NO: 52913 - DNA, 369 bp, Homo sapiens
aatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcctaccagagtacctggtgggctgcagagcataagtacatccaggttgtctaccttcataacaacaatatctctgtagttggatcaagtgacttctgcccacctggacacaacaccaaaaag

SEQ ID NO: 52914 - DNA, 384 bp, Homo sapiens
actgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaag

SEQ ID NO: 52915 - DNA, 309 bp, Homo sapiens
tataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgaagaaaagacaaggacatttactaggggggattgtgggcccaatcggcatcataagcatgtctgaagcaaaagacaataatcacatccaacggcaccagttcagctcaactttagaat

SEQ ID NO: 52916 - DNA, 290 bp, Homo sapiens
aaatagcctaacaaccagaaaagcccaggattaaatggatttacagctgaattctaccagagttacaaagaggagctggcaccatttctactgaaactattccaaaatggattaggttgggcttctccctatgaggccagcatcgtttgctaccaaaacctggcagagatacaacaaagaaccttcagcccaatatacttggtgaagagcaatgcaaatgccctcaataaaataaaatactgacaaatgaaatccaacagcacatcaaaagcttatccaccacaatcaag

SEQ ID NO: 52917 - DNA, 380 bp, Homo sapiens
acatccaggttgtctaccttcataacaacaatatctctgtagttggatcaagtgacttctgcccacctggacacaacaccaaaaaggcttcttattcgggtgtgagccttttcagcaacccggtccagtactgggagatacagccatccaccttcagatgtgtctacgtgcgctctgccattcaactcggaaactataagtaattctcaagaaagccctcatttttataacctggcaaaatcttgttaatgcattgctaaaaaataaataaaagctagatactggaaacctaactgcaatgtggatgttttacccacatgacttattatgcataaagccaaatttccagttaagtaattgcctacaataaaaagaaattt

SEQ ID NO: 52918 - DNA, 261 bp, Homo sapiens
  misc_feature 225, 230: n = A,T,C or G
taaccccgggcaagacttttctttgaaggatgactacagacattaaataatcgaagtaattttgggaggggagaagaggcagattcaattttctttaaccagtctgaagtttcatttatgatacaaaagaagatgaaaatggaagtggccgatataaggggatgaggaaggcatgcctggacaaacccttcttttaagatgtgtcttcaatttgtataaaatggngtttncatgtaaataaatacattcttggacaaaaaa

SEQ ID NO: 52919 - DNA, 161 bp, Homo sapiens
  misc_feature 46: n = A,T,C or G
tgctgtattcatttctccaatctcatgtccattttggtgtgggagncggggtagggggtactcttgtcaaaaggcacattggtgcatgtgtgtttgctagctcacttgtccatgaaaatattttatgatactaaagaaaatcttttaaaaaaaaaaaaaaa

SEQ ID NO: 52920 - DNA, 344 bp, Homo sapiens
  misc_feature 42, 213: n = A,T,C or G
ggaaggttgtcataaatggtggcactgcgagctgaggttggntgatgcatgctctttaagaaaaggctaattttctggaaagaagtttggctatgcctaaaaatgttcatccatctctgaggaaataatgagaaatatgaaaaggctttatgcacaattatattgtttgtaaaactaattccaatagccaaaaacagtaaacaagttaaatgnccacgtaggaaaatgattaaacaaattttgggctagctatatgatgtaatgataagtggccttttaaaacaaagtttatgaagaattttaatggtaggggaaataccatataatcaaaagatgataggatg

SEQ ID NO: 52921 - DNA, 408 bp, Homo sapiens
aacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagagttttctcataaatgagggctgcacattgcctgttctgcttcgaagtattcaataccgctcagtattttaaatgaagtgattctaagatttggtttgggatcaataggaaagcatatgcagccaaccaagatgcaaatgttt

SEQ ID NO: 52922 - DNA, 227 bp, Homo sapiens
ttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaccc

SEQ ID NO: 52923 - DNA, 307 bp, Homo sapiens
ggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcaccctcactgaaaaagatgagtatgcctgccgtgtgaaccatgtgactttg

SEQ ID NO: 52924 - DNA, 346 bp, Homo sapiens
  misc_feature 18, 97: n = A,T,C or G
gagagaaaataataggtncaaaacttacttttctacatgaaccttgtaggtccaaagcttactttttagcatgaaccttgtataaatttgaactctncagcttcgcatggcaccaggaaagctgaaaggatatcagggttttaggacttccccactcctcacaatggaactgccacagccagtgagaactgaggtcatgcatcttagagcagtagcataggggagggatgaagatgtatccaggctgaagccagctgctgtctgagtgcccacgatacattcatgagcaaaacgaggagcttggccttctggagtatttattctagcagaaagagacagacactga

SEQ ID NO: 52925 - DNA, 313 bp, Homo sapiens
  misc_feature 249: n = A,T,C or G
gaaagtgcatggtagctctacattctcttattaatgtttgataatgttaggtcattttgggtggttttcttgaattgcaccaaattttatttttaggataaggatgctaaattccgtctgattctaatagagagccggattcaccgtttggctcgatattataagaccaagcgagtcctccctcccaattggaaatagtaagtatcaactcttttgtcgttgttatcaagaataggagcagccagtagnaaaagtcctagtagtaaatatgttcagccttgggggctagtagtaaatatgttcagccttgggg

SEQ ID NO: 52926 - DNA, 222 bp, Homo sapiens
tctccatgccttagttagatgaccctcaaaggggcacagcaagatttccctggctactgatacaccttaacaagaagcttgtgttttttatgccctcaaaagtgttttacttatactttcctagacataaaggtggaaaatgggcctaaggtctgtcaaaggtcttggaaaagaagattgtattaaaattgctgtccgtcttcattaaataatactagatcg

SEQ ID NO: 52927 - DNA, 176 bp, Homo sapiens
  misc_feature 9, 34: n = A,T,C or G
gtacagggnaatttcatgtcaacttattcctganatttacatactaggaagtaaatgggtttatagaacaaagcagagtactattgaatggtttgtggggtcagacatgatgacataatgaaatgtgtcattcaccattcctgtttcaattgtgatgaaggcatttaatgattagc

SEQ ID NO: 52928 - DNA, 257 bp, Homo sapiens
  misc_feature 91: n = A,T,C or G
atgagagggtttactgggtaaattatgttattttttacaactaattttgtctctcagaatgtttgcatatgcttcttgcaatgcatatttnttaatctcaaacgtttcaataaaaccatttttcagatataaagagaattacttcaaattgagtaattcagaaaaactcaagatttaagttaaaaagtggtttggcttgggaacaggactttatacctcttttactgtaacaagtactcattaaaggaaattgaatg

SEQ ID NO: 52929 - DNA, 306 bp, Homo sapiens
  misc_feature 31, 80, 176: n = A,T,C or G
cacaacctagttattttaaaaattatgttgnctaaatacaaagtgttgttttctaaaatgtaaatatttgccacaatgtnaaagcaaatcttagctatattttaaatcataaataacatgttcaagatacttaacaatttatttaaaatctaagattgctctaacgtctagtgaanaaaatatttttaaaatttcagccaaataatgcattttatttataaaaatacagacagaaaattagggagaaacctctagttttgccaatagaaaatgcttcttccattgaataaaagttatttcaaattg

SEQ ID NO: 52930 - DNA, 162 bp, Homo sapiens
  misc_feature 70, 156: n = A,T,C or G
atacacaattccaaaaaagcaagaagattctgtcactgagttaacagtgtaagattctgggtgaaagctnggaagacctcatggccaaaatgaagaatatgtagataatgggactggggatatattgtatttctcatgttaaaggcctcttccctngaaatt

SEQ ID NO: 52931 - DNA, 248 bp, Homo sapiens
  misc_feature 152, 187, 217, 218, 230: n = A,T,C or G
ggatgatgggacatttacctctattgtctagctaagggctttcggccaccagtaaataagatcaaacggctcttaaatgtcctgttaccatcctaatggaaatactggatttttctgtcatttagcaccatgctgcttctggctggctaaangctggcattaagacatgagcccttttctccagagnacagctttgaaaactacttctattaagtanngagcacttgganatttttcataactatatt

SEQ ID NO: 52932 - DNA, 377 bp, Homo sapiens
  misc_feature 29, 62, 271, 338: n = A,T,C or G
tagggttggggatcaatcctgaatttcgntatgtgttaaatttacttttattaaaaaagtanagcatatataatacaaaacaataacccttctggggtttcttgtggcgggtgaaataagcccacatgtggtcatcaagaaaataagccattcctcataccaatataggatcaagctccttgacctctgaggggcaggagtgcttcctggtgtgggtattagaatcccttcctgccttggttcatggcagtgaaatgcctcttggtcctgnccaagggtatctttcactgattctgaatcatggtctaggttgcttgaccctgccacatgggtccagngtcatctgagcataactgggactaaatcctttttcatat

SEQ ID NO: 52933 - DNA, 382 bp, Homo sapiens
tgtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcagaccagtggaaatgtaaagaaggccctgaagctgatggggtcaaatgaaggtgaattcaaggcttgaaggaaataacaaatcacctacacagttctggaggatggttgcacgaaacacactggggaatggagcaaaacagctttgaata

SEQ ID NO: 52934 - DNA, 417 bp, Homo sapiens
  misc_feature 30: n = A,T,C or G
ctattataatgggatactgatctggctatnatttaacaagaatcacagccttaatgaaaaacgtggaaaacatctattttcttttaaaaaataatattttcttttgtttttgatagaatcaagtagaagtggccaggcgtgatggcttatgctgtaatcccagcactttgggaggttgaggcaggaggattgcttgaggccaggagtttgagaccagcctgggcaacataatgagacttcatctctataaaaaataaacaaaaaattagctgggtatgatggcacgtgcctgtagtcccagctactcaggaagctgaggtgggaggatctccttgagccccggaggtcaaggctgcagtgagccaagatcacaccactgcacttcagcctgggagacaaaggtaacccttgtctcaa

SEQ ID NO: 52935 - DNA, 408 bp, Homo sapiens
aacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagccgaatccttccatttcttctgcacatctacttgcttaaattgtggcaaaagagaaaaagaaggattgatcagag

SEQ ID NO: 52936 - DNA, 413 bp, Homo sapiens
  misc_feature 25, 26: n = A,T,C or G
tgttcctcaccatgtttggtggagnngtttaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgtggatttattctcaagcattttgggcatatgtatcttataatcagac

SEQ ID NO: 52937 - DNA, 367 bp, Homo sapiens
  misc_feature 20, 25, 145, 152, 235, 242, 338: n = A,T,C or G
cgcagctatttgcagatatngcaanatgcttgctaggcagctacatcatattagttttttaaaaaatacctctgtaacaagacctaaaagtaacctaactattaagcagtgcttttttctctgaaaacacacaacctaaagattnatctgtnataaaactgcatggtccagagctttatttctgtgtagagatgctatttgttagtgatggaaacaaattactttggtgctatgncttttgngcctagcagttgagagaatgatatgaccatcatatcactggattatgggaatgaatgcccttttcaaaataaacttatttattaatattttaatantatttaaatattataatattaataatatt

SEQ ID NO: 52938 - DNA, 375 bp, Homo sapiens
  misc_feature 281, 363: n = A,T,C or G
ttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgctagtagttctctccagggcaaatgaagctcacagttttgcaaggtggaaacctcttattcacatttgctttgattccccgatggagtagactgcctttgntccatacaggcaaagtaaggatattttaatatcatcctacttcttattagcatttcattggctatgtactgaatttcattgnatgctcctgaaa

SEQ ID NO: 52939 - DNA, 434 bp, Homo sapiens
  misc_feature 234, 237, 270, 322, 334, 402: n = A,T,C or G
gctaatatttgttatcttaattaagactatttgtgaggtcatgattacttgaaaatattgactaaaactgggtccttagaaattccaggtggagctgatttacctatgactgaggggaaaaaaaatcaaattttactgataatagtaatgctccaaatgaattaatgacacatctgttcaataaataaagagcttaaatatacaaaacataagaaatctgggcacaaaacttgnggnctttacttttgaataagctacccaagaaaaggntttaaaggtaaaagttatgaggaatgcatcacaataagctcttggttaaaanctttctttatgnataataaggttatgttcatgtctttttaaaaccttataaaagatttaatatcacatctattcttcaanggggaaaattaaatattgggggtgggaaaata

SEQ ID NO: 52940 - DNA, 241 bp, Homo sapiens
  misc_feature 190, 213: n = A,T,C or G
aaaaattcctggagccatatatataccctctgggttcccccttcgttagtcgtatatggcctagagacagcaatacaagaatctaatgatacaaacaaaggccaagtaaactttaagggtgcagacatgaatggattaccaacaaaaggaccgcagaaatctgtgataaaaagaaagactactgaaattntcctaaaggaccccatcatttanaaaatggacccgataatatgaagcatct

SEQ ID NO: 52941 - DNA, 411 bp, Homo sapiens
  misc_feature 383: n = A,T,C or G
ttaaagctacctgacactaagaggtgtctgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcagctggaggaggctgcattgaggcgtgagcaaaagaagttggaaaagaagcaaatgaaaatgaaacanatcaaagtgaaagccatgtaaaggccat

SEQ ID NO: 52942 - DNA, 276 bp, Homo sapiens
tgtgtactttggttttgttactgaatgttttaaaaagcaaataataaaatttctaagcatttgaggaaaattttaaggataaattgaggaaactgattaatagagatagcaagggataattaaataaatattccctatgtagcaacagtggttagatgatctttgtctgaatgtaattaaactttgaatagttttagtgtgccttaaagccaagtatatgctttaacatcaaatggaagtcaaattcctaatgcatagatagagagagctaaactg

SEQ ID NO: 52943 - DNA, 263 bp, Homo sapiens
  misc_feature 135, 212, 226, 243: n = A,T,C or G
gaataattcagtgcacacctgtaggcttctttacattgtgactgataggggttattgcgtatcaatttggggctgtagagtgcaatctcagttccatctttttcacccatcagaatttgctcaggattacttggnttttctcagtcctcaagcgagaacttgcttttctttgtaatgtgactttcattactgagtacccacgtatttggagnatgagaaggggggntatttctcatactctgnccctctcttttcattgaatg

SEQ ID NO: 52944 - DNA, 293 bp, Homo sapiens
  misc_feature 33, 67, 68, 185, 262: n = A,T,C or G
tttgatttccggagtagaattttaccttaattnacttaaagaaaattaaccattttttggtccaacnncagatattttcttaatccagaagctgtgactgttcccagaagaaacctcttatatcacatttaaaacataaaaaataattacactttcactcattctaatgggtaaattgttgaatngtaataaacaactgtatatttacaaacaggttataaggatttgctatcaaattaataataaaataaaacttacgggnctgcaaggaaaactatgaaggccacttaaag

SEQ ID NO: 52945 - DNA, 279 bp, Homo sapiens
  misc_feature 13: n = A,T,C or G
atttccatcggtncttactttcgctcgtcagactccagcagccaagatgggctagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtgggatgactgcaggatgttgcttcagagtgtgaagcaaatgcatgccaacattccag

SEQ ID NO: 52946 - DNA, 300 bp, Homo sapiens
aaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccct

SEQ ID NO: 52947 - DNA, 330 bp, Homo sapiens
tttttctgaggaaaaaataggcatgggctacaggactatttaaaatgtctcattttacagtataaaactcaaaggtaggatgtaatttttacacctatgagtatttgtccaatttctgtctcttcctcaccattgggtatctattctttatatgtaaataagataaggcatctgatagccttattcagtcttcatcattttcatcattgtcctatgtagattattggacatttattgtagcactacataactgattataaaaatctgtaaatgaattagcactttcatattgaaacaagcctgctagcctatgtataaaatagcaaaatg

SEQ ID NO: 52948 - DNA, 215 bp, Homo sapiens
cagtacttcaaaaaagtgacatatatttataaatagcaaacaaaaatgagatggtatggcatttttctcatatatcatggacaacttttcatggcagtaaatattcatttttaatagctacctaatacattggatggagattccacaatttaaaattttcataataatagaagcaagcatggtgcacatcagtgaagtccattgactttctaaga

SEQ ID NO: 52949 - DNA, 314 bp, Homo sapiens
aggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttgctgggcctccttccccaggaattaagaccaagaagcctggggggcctgagagacttgaacaagtgtcaataaacgctgcctctaaaaaaagga

SEQ ID NO: 52950 - DNA, 349 bp, Homo sapiens
  misc_feature 229: n = A,T,C or G
aaatatgcccctccccataatggaatactaatttttatttgatcactcatttatagcagttgcttaaatgtatgtatttatatgaaggtattttaatttttaagagcaaaaaagttctaataagttgccggatttctaataaatgcaggtttatttggtgaaaagataaggaaaatgagttatgattctgtagtttttttaaaatgagtcagcataattgttttcaggnttttttagttactggggttattctgcataagaaagcccaatgctttctgatagtaggagataatttttctctctttgactttgaaatctgacttaggagatgaattctttttaaaaaggt

SEQ ID NO: 52951 - DNA, 315 bp, Homo sapiens
cagaatcagaggtatcaatggagtgagcccaaaggttcgaaaggtgttgcagcttcttcgccttcgtcaaatcttcaatggaacccttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactggtgg

SEQ ID NO: 52952 - DNA, 311 bp, Homo sapiens
aggagatggtgcagaaaatgttgctgctgatcagcctgctaacccaccagctgagaacgcagtggtgggggaaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgactgctgaagagcttacatgggaaagaatgctaggacttgatggatcactagtttttctggaacatgtcttctgggtggtatctttaaatacactgt

SEQ ID NO: 52953 - DNA, 320 bp, Homo sapiens
tcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgccaacagagtctaggctgggttcattacatgattcatgagccagaaccacatattcttctctttagacgaactctttcaaaagatcaacaaaaatgaagtttatctggggatcgtcaaatctttttcaaatttaatg

SEQ ID NO: 52954 - DNA, 338 bp, Homo sapiens
  misc_feature 81, 242: n = A,T,C or G
aatatttatttactgcatctgaagaaaggtgtgatatgtcagaaacatttggttaatgagaatgcaaaactggtagataanggattatgacaatgagatctttatttatgctatgcccctaggcactacctcattcatactatgtagtaggaatatattttttccataataacaaaacaaatagttaaacacatgaagtgtttaacattacaaacccttgctagaaaaggttagagctgggncttatttgtcattagtttgtacatttatttattcacaaaaaaaattgtcaggctttgggcttcttgctgatgatataaatgaggagaaaacaacat

SEQ ID NO: 52955 - DNA, 230 bp, Homo sapiens
gtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtcaaaaaaaa

SEQ ID NO: 52956 - DNA, 280 bp, Homo sapiens
tggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacactt

SEQ ID NO: 52957 - DNA, 318 bp, Homo sapiens
ccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgcactcagagaaaagagtgccatctaccgaaactccacagtttccattgtgaatggcttctttggtgcagagtccaaaaattatgtagcccagctctttaattttg

SEQ ID NO: 52958 - DNA, 263 bp, Homo sapiens
ggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgggt

SEQ ID NO: 52959 - DNA, 327 bp, Homo sapiens
ttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgcggaggttgagatgaagcttcttcatggagtaaaaaatgtatttaaaagaaaattgagagaaaggactacagagccc

SEQ ID NO: 52960 - DNA, 285 bp, Homo sapiens
  misc_feature 44: n = A,T,C or G
aatccttgaaggaaatgacattgagcttgtttcaaattcagcgnctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttctcagaaaaaaaaaaaaaaaaaaaaaaaaaa

SEQ ID NO: 52961 - DNA, 438 bp, Homo sapiens
gagacagagaagaggttgctccccaagccctgtcatcccagggtgacggtggcacactggtgcttcgacaccgagactgctgctggggaggaagaggggcacacaggcatcacaacagtaagccagccagtcaccaaagactaaaccagtgaataacaggcccaggatggggactaccaaaagggctagaatatcttgtctaaaatgtccagtttctaacaaagaatgacagggtatgtggaggaggaggagggaaggaagaaaaagaaaaagaaggaaagtatgactcatacattaggaagaaagcaacaaaaactgctgtgagagtgaccaaatgtcaaatttaactgaatgagatttcaaagcagccactatcaatatgttcacaaaactaaaggacgcataaatgaacatgccacaaatagagctgttggtaaa

SEQ ID NO: 52962 - DNA, 436 bp, Homo sapiens
tgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaa

SEQ ID NO: 52963 - DNA, 400 bp, Homo sapiens
actgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagatccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaa

SEQ ID NO: 52964 - DNA, 148 bp, Homo sapiens
ccaccataattacccccatactccttacactattcctcatcacccaactaaaaatattaaacacaaactaccacctacctccctcaccaaagcccataaaaataaaaaattataacaaaccctgagaaccaaaatgaacgaaaatctg

SEQ ID NO: 52965 - DNA, 117 bp, Homo sapiens
  misc_feature 109: n = A,T,C or G
acccaactaaaaatattaaacacaaactaccacctacctccctcaccaaagcccataaaaataaaaaattataacaaaccctgagaaccaaaatgaacgaaaatctgtncgcttcat

SEQ ID NO: 52966 - DNA, 383 bp, Homo sapiens
gaaaagcccacagttaataccatatgcaactaggaactactgtttttcctctatgatcaggaacaaagcaaagatgcccatccttaccactactattcaacatagtactgaaatttccagccagagcaattaagacaaaacaaaacaaaaaaattttgttatatatagcatatgacaaaaaaaagaaaagacacacaattggaaaagcagaagtaaattctctctgttcacagatgacatgatcttatatttagaaaatcttaaagattctgcacagaaactattagaactaggaaatggattcagcaaagtttcagcacacaaaaccaacactcaaaaatcagttgcatttctataccaatgaccaattcaaaaaaaaaaaa

SEQ ID NO: 52967 - DNA, 413 bp, Homo sapiens
ataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactct

SEQ ID NO: 52968 - DNA, 223 bp, Homo sapiens
tgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactta

SEQ ID NO: 52969 - DNA, 182 bp, Homo sapiens
acaaaaaatgacatggtggtcggtgcctgtaatcccagctacttgggaggctgaggcaggagaattgcttgaacccagaaggcagaggtggcagtgagctgagattgcgccattgcactccagcctaggctgcaggagtgaagtgaaactcatcccaaaaaaaaaaaaaaaaaaaaaaaaaa

SEQ ID NO: 52970 - DNA, 355 bp, Homo sapiens
caagctccagtgctacgtgtccctggcattttaggtgtcgggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggggctgaatacattttggaagagagttttcatcttagagattggtgaacaagtgtgagggtgtgagaaactcacagaatacaaatttgcctgtatgtttg

SEQ ID NO: 52971 - DNA, 213 bp, Homo sapiens
  misc_feature 48: n = A,T,C or G
gaaagcagctggcagtgttaggacattagtccaccttcagcgcagggnctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttatca

SEQ ID NO: 52972 - DNA, 353 bp, Homo sapiens
ttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgcctggttgcccctccactgagagttgctgaaacaaagaatttgtcctgtatggaaaacgggagactttg

SEQ ID NO: 52973 - DNA, 222 bp, Homo sapiens
actccccaacatctcatgaaaattataccaaagcagtcacggtatttcttcattactagtgattggaaaaggaatgggagaaaagtgttggaacaaaaattctaacccctaaaagagaataaccaaaacaacaaaaaaatactctgtctttctttcgtatgtctaaggcctgatttcctctcctgcaactggcaaggctagtgattaggacctagagtaagg

SEQ ID NO: 52974 - DNA, 310 bp, Homo sapiens
aattctttcaatgtgtcatccctggttgagctggatctgtcctataacaagcttaaaaacataccaactgtcaatgaaaaccttgaaaactattccctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagcactcttaattaatatctgtatcctggaacaatattttatgggtatggttt

SEQ ID NO: 52975 - DNA, 341 bp, Homo sapiens
  misc_feature 111: n = A,T,C or G
tttttcaaaaatggcaatggtatcagaattcctcaagcaggcctggtttattgaaaatgaagagcaggaatatgttcaaactgtgaagtcatccaaaggtggtcccggatnagcggtgagcgcctatcctaccttcaatccatcctcggatgtcgctgcttgcataaggccataatggttaaaggtgtggatgaagcaaccatcattgacattctaactaagcgaaacaatgcacagcgtcaacagatcaaagcagcatatcttcaggaaacaggaaagcccctggatgaaacactgaagaaagcccttacaggtcaccttgaggaggttgttttagctct

SEQ ID NO: 52976 - DNA, 159 bp, Homo sapiens
aaactatattgtgtcaatgcttaaataaatttatggtcttcagtagagagtctcattctgatatgttgatcttcttatcttagattatattttgttatggcctgtcagaaaatcatattaataaatataatttgggaattttattctatcctgaacttt

SEQ ID NO: 52977 - DNA, 208 bp, Homo sapiens
  misc_feature 59: n = A,T,C or G
tcagactatccacctttgggtcgctttgctgttcgtgatatgagacagacagttgcggngggtgtcatcaaagcagtggacaagaaggctgctggagctggcaaggtcaccaagtctgcgagaaagctcagaaggctaaatgaatattatccctaatacctgccaccccactcttaatcagtggtggaagaacggcctcagaactgtt

SEQ ID NO: 52978 - DNA, 167 bp, Homo sapiens
atataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttga

SEQ ID NO: 52979 - DNA, 506 bp, Homo sapiens
  misc_feature 246, 258: n = A,T,C or G
acttgtggagacagccgctcaccttggctattcagttgttgctatcaatcatatcgttgactttaaggaaaagaaacaggaaattgaaaaaccagtagctgtttctgaactcttgcaactttgccaattgtacagggaaaatcaagaccaattaaaattttaactagattaacaattattgtctcggatccatctcactgcaatgttttgagagcaacttcttcaagggcccggctctatgatgtngttgcagttttnccaaagacagaaaagctttttcatattgcttgcacacatttagatgtggatttagtctgcataactgtaacagagaaactaccattttacttcaaaagacctcctattaatgtggcgattgacccgaggcctgctttttgaacttggctatagccctgctatcaaagactccacaatgagaaggtatacaatttccagtccctcaatttggatgcaaatctgcaaaggaaagaatgtaattatatcta

SEQ ID NO: 52980 - DNA, 221 bp, Homo sapiens
  misc_feature 26, 31, 47, 49: n = A,T,C or G
aggcattgaggcagccagcgcagggncttcngctgagggggcaggcntnagcttgaggaaaccgcagataagtttttttctctttgaaagatagagattaatacaactacttaaaaaatatagtcaataggttactaagatattgcttagcgttaagtttttaacgtaattttaataggcttaagattttaagagaaaatatgaagacttagaagagtagc

SEQ ID NO: 52981 - DNA, 129 bp, Homo sapiens
  misc_feature 35: n = A,T,C or G
ccctgcaatcccaagtattcaggaggctgatgcanggagaatggcgtgattctgggaggcagagcttgcagtgagccaagatcatgccactgcactccagcctgggcaacagagcaagactctgtctcc

SEQ ID NO: 52982 - DNA, 110 bp, Homo sapiens
gcttgcaagagaatctggatgtggtacgtgtctttagctgagagacattattataactgtgattttaaaatgtgctacaagcttacttctgtagtaatggagaaagatcc

SEQ ID NO: 52983 - DNA, 154 bp, Homo sapiens
gacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcggga

SEQ ID NO: 52984 - DNA, 338 bp, Homo sapiens
  misc_feature 179: n = A,T,C or G
attatgtacatgcataaagctgtgtgcatactcaggaaaaagctgagaaggccctaaactctcaccaatggctgaccttgaggcactgcataagtaggtgaaggctaaggagaagctgttaacttgtggctaagtattaaaggtgtgccccaacacacagagtccccaatacaaagagnagtattgattccaggcatttaaggaaatctgtccaattattagcacactactaagcatatgaatcagatatttcatacacaacaaagaatatagactttacaaatatatagtcagaaaggtcagtaaacagcaaaatatagcaacaacagttaaaaaaa

SEQ ID NO: 52985 - DNA, 260 bp, Homo sapiens
aagtgggagcaagcatatttctttgtggaagtatagtcctatgtgtttaatatgtaaccaaactttgtctgtgtcaaaagaatacaactgaagatgccattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatgcagttacataataagtg

SEQ ID NO: 52986 - DNA, 193 bp, Homo sapiens
caggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgcaaaaaaaaaaaa

SEQ ID NO: 52987 - DNA, 334 bp, Homo sapiens
  misc_feature 178: n = A,T,C or G
agtgagtatgaggcaaggactaaggttaaacagatcctatgggaaatgatcttacgagaaaagatattttattttctctgaagacactaaaaccacttattgttgggtaggaatccaatgtgtaccttaggatagaattgttctttgtccttcaatgtctttgtctgttcccagtganaatgtccctgtaaaacactatagctaatctaatattgcgtggtttcttaagccttggatcctttatgaccagctgcatgtaagatgattcagtatctacctaccaagtaatttcaggagaactgcagatgatgcaatgacttgcagacatgcacag

SEQ ID NO: 52988 - DNA, 393 bp, Homo sapiens
  misc_feature 50: n = A,T,C or G
gggacatgaaagcacatgtctgcataaaggttcatgtatgaatattcacngcagcattattcataacagccaaaacctggaagctgtcaagatacccatccactgacgaatgattcagcacactgtggtatagtcataaatggaatactactcagccatgaaaaggaacaaattcctgataaacaccacaacatgaatgaattgcaaaagcagtgctctgagtccaagaagctgggcagaaaggagttggtgccctgattccatttttctcaagttgtagaagaagcaaactaatctacggtaggagaattgcaggaaaggggcacaaagaactttttggggtgatggaaatattttgtaccttgctttagatgtgggcagatggaatatacg

SEQ ID NO: 52989 - DNA, 393 bp, Homo sapiens
  misc_feature 6, 61, 137, 258, 280, 295, 336, 374: n = A,T,C or G
ggaacnaggacaattcttggtacctcctaaagggaatcaacaaattaagagcctactatgngaactgccttggtcaaaactctttcatgagtgaggaacagaagcttactcaggccacattgagggaggggaggtanagaaaatctcatgggcattcaaggagaacaaagtacagcagaatcaacaagaattacagctgcaaccagtacttgactagactgccaggatttgagttctctgtctctcaggattttgggncaggcagtgtaacatagtgganaagagctcaggcttnggatcaaggaagacgacgattcaagtcttggctttgccacnaccacctgggcctttggggagctgtctagcttctgggncctggaatacgattcatct

SEQ ID NO: 52990 - DNA, 389 bp, Homo sapiens
  misc_feature 23, 24, 92, 104, 112, 114, 124, 126, 136, 151, 169, 194,197, 230, 247, 252, 284, 303, 348, 349, 373: n = A,T,C or G
acccggcctttggccgggatttnnaattacctgataacttaagactctgtgatctctggaatcaccatatgtttcttttttgtgtagatatnaataacattacnctttgacnanagtgtgcacncngaaatgtacncagtgaaaatttgtnttgagtttcattaatgcnatttcaccagttagacataattacntcnaccgatgtgaatgatacggatgccggcagagcntccagatctttcagacncaacngctaggtcaattagtttgtcataataaaactnggcaagattctacaagtcnattatgacaaaccaggactaattctataatgggaaaactatccannctggaataataaggatgtaattantttgctgctgctgctg

SEQ ID NO: 52991 - DNA, 190 bp, Homo sapiens
  misc_feature 3, 17, 61, 75, 80, 81, 90, 108, 116, 154, 161, 167: n = A,T,C or G
cancaactgaggaagangacaggcgtcttggctttgttgcaccttgttttattttttattntggctctgcagacnggggnnaagtgggcnaagaccagaagagagacntattcgcntaagtaagaaacatgtgccttttattaactgcagtccngcatttnatccanggaatgacagaccctgtattaac

SEQ ID NO: 52992 - DNA, 398 bp, Homo sapiens
  misc_feature 1, 10, 56, 188, 320, 333, 340: n = A,T,C or G
ncgagctaanccaagattcacccaagtgttgaatatggcctgaaggtgggcttgcngcatgagtcaaggctgcctgcgagggacctgccactttgggttaatcataatgcagatccatatgttgggtgtttgtttgtttgttttaataaaccatgatgcattttaggtagatttttctaaagcgaccnctggcttaaaaattcataatcaaatgccctccacaccctcgtctaaccttctaattccatacttcagaaggcataacactaattcctttcttgagtgttttctcacccaagcttaatataacagatacttgnacctccagactgnaggcatnacgctgtaatataagtactgcaaaattttaaaatatgtttcatttcactggagatata

SEQ ID NO: 52993 - DNA, 393 bp, Homo sapiens
  misc_feature 8, 64: n = A,T,C or G
ctacccantttgcttggtagcccggatggtgagcatattttaacagctacatgtgctcccaggntacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaccacctcagaatatgaaaccacaatcaggaacgataagccattatcaaaacagctcttaaaaatcaaaggaagcat

SEQ ID NO: 52994 - DNA, 118 bp, Homo sapiens
  misc_feature 33, 74: n = A,T,C or G
tgccctactctgtagaatctgggactggcaaangtttgtgtggcctccttaaactagctggtatgttatgattntattctttgtgagttaattagaataaagcattttcttccaagct

SEQ ID NO: 52995 - DNA, 139 bp, Homo sapiens
  misc_feature 68, 69, 74, 85: n = A,T,C or G
ccagtagggtgctcaagctatttaaaaacaaaactattctcaaacattcatcatttaagacaactggnngtttntgctgggtttnggaacctaccaaaatgggataggctgttgaacatttccacattcaaagggtttt

SEQ ID NO: 52996 - DNA, 273 bp, Homo sapiens
gagacgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgaccgatttatgatcttaaatcttttttacaa

SEQ ID NO: 52997 - DNA, 233 bp, Homo sapiens
ctggctaatttgtgtctcattttcaagagtagaaaccctaaatattttattttcattccttttccaaattgctatgaatgggattaaaggattacagatgtaaagtctattatttgtgaattctaaatgtagttctgctgttgtacctgtggaaacatcttaaagaagtacatattttgcacgtcctgcacgtgtaccccagaacttaaactataattaaaaagaatagtttc

SEQ ID NO: 52998 - DNA, 235 bp, Homo sapiens
tcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttatcggtaaagattgtata

SEQ ID NO: 52999 - DNA, 168 bp, Homo sapiens
acacaaacacatcagacactccgtcctcacactggcaggacggtgttcatcgcattctcttctgtgaccagcctctaggctagcggctgcattcgtggctgtgcaaacacttcgtggttctatatatcagcagcaagtgtgcaaaataaaggacctgttaactcagaa

SEQ ID NO: 53000 - DNA, 220 bp, Homo sapiens
aaggtttttagcatggtcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaa

SEQ ID NO: 53001 - DNA, 249 bp, Homo sapiens
tgggcaaggagctgactcggcagtggacaaattgaggcaaccaaataataaacacaaatggatagtcaacacattttttgaaagaacatctgaaagacaaaatggggaatggcgagtctgtctaataaaccattttgagaaaactggatattcatataaagaagtataaagaggactgttatgttgcacaatacacaaaaatcaactcaaaataaattaatgacctaaactgaaaaaaaaaaaaaaaaa

SEQ ID NO: 53002 - DNA, 149 bp, Homo sapiens
  misc_feature 135: n = A,T,C or G
ataaccgacagggctggtgaaagtccccagatggcaggatatttggtttctgagtaaggactaggtgcgccaccatgactgactatcaatcaaaatgtttgtaacttaaaatttttaatgaaggataatgaatantaaagaaaaaaaaa

SEQ ID NO: 53003 - DNA, 278 bp, Homo sapiens
aagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgctaaaacactttgggtggtattgatggagttggtggattttcctccaagtgattaaatgaaatttgacgtatcttttcatccaaagttttgtacatcatgttttctaacg

SEQ ID NO: 53004 - DNA, 321 bp, Homo sapiens
tgaaatctacttcatacacagtttttaagcaatctttcagtcattttttcatcagaagaaatcaaggcagtttagaaacagtaaaactttatatttgcctaaactcaacaactaggttttttatattataaaacagtcatgttggattaaatctgattattattttattgaatgcgtattcctaacactgaattttaaagctatcttctctagttaatagagcctttttgttttaagtatttatattccagaaacaagaatcaagcaaaagcacattttaatctttcctgtaaatgtatatatttggcactttataagact

SEQ ID NO: 53005 - DNA, 375 bp, Homo sapiens
  misc_feature 102: n = A,T,C or G
agagatcaaactttaatagacatcagagggttcacactggagagaaaccttataaatgttcgcactgtgggaaaagtttcaagctggagctcgagccttganaaacatcaaagatcccacttaggaaagaagccctttcaatagccagtaaccaaactctctttccccatttctatctcccagcccagtcacaaaaatactcagctccatcaagaggaattgtgctaagaggatacccctgttaatctccttttttcttggattggagaggagagaatctggacatggctttggacttggaggatatcttggattggattgcacaatggcttaaattcttgattctgcctcaggagaaagaatagtcttcatgtt

SEQ ID NO: 53006 - DNA, 223 bp, Homo sapiens
  misc_feature 41: n = A,T,C or G
gcattttaaaaataaagttccggagaagcaaaaactgttcnaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagttcat

SEQ ID NO: 53007 - DNA, 179 bp, Homo sapiens
  misc_feature 106, 145: n = A,T,C or G
gcagtttttcaggagcgcaagatagatttggaataggaataagctctagttcttaacaaccgacactcctacaagatttagaaaaaagtttacaacataatctagnttacagaaaaatcttgtgctagaatactttttaaaaggnattttgaatactattaaaactgcttttttttttt

SEQ ID NO: 53008 - DNA, 364 bp, Homo sapiens
caatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgagatggctggatcgcttgggagaaagtaaatacttgatggctctgaagaatctgtgtgacttggcattgtagatccatatccaccattatgtgacattaaaggatcatatacagcg

SEQ ID NO: 53009 - DNA, 321 bp, Homo sapiens
aatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctggggtcagttttcatagtatccatattttattactggttattacttccatgaattttaaaatctgagggaaatggtttg

SEQ ID NO: 53010 - DNA, 311 bp, Homo sapiens
  misc_feature 61: n = A,T,C or G
tatctgagaagataaccatcggtgagtacccagagctccatgcccattccacactctcctngcagcgggtcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaattatgggtggaaggctcagcatgctgacgagatgcactgatactaaaacagcctt

SEQ ID NO: 53011 - DNA, 300 bp, Homo sapiens
  misc_feature 102: n = A,T,C or G
acagaccactggttcacctacaatgagacaatgacagtggagagtgtgacccaagctgtgtccaatctggctttgcagtttggagaagaagatgcagatccnggtgccatgtctcgtccctttggagtagcattattatttggaggagttgatgagaaaggaccccagctgtttcatatggacccatctgggacctttgacagtgtgatgctcgagcaattggctctgcttcagagggtgcccagagctccttgcaagaagtttaccacaagtctatgactttgaaagaagccatcaagt

SEQ ID NO: 53012 - DNA, 391 bp, Homo sapiens
  misc_feature 172: n = A,T,C or G
tacgtgcgctctgccattcaactcggaaactataagtaattctcaagaaagccctcatttttataacctggcaaaatcttgttaatgtcattgctaaaaaataaataaaagctagatactggaaacctaactgtaatgtggatgttttacccacatgacttattatgcatanagccaaatttccagtttaagtaattgcctacaataaaaagaaattttgcctgccattttcagaatcatcttttgaagctttctggtggatgttaactgagctactagagatattcttatttcactaaatgtaaaatttggagtaaatatatatgtcaatatttagtaaagcttttcttttttaatttccaggaaaaaataaaaagagtatgagtcttcg

SEQ ID NO: 53013 - DNA, 285 bp, Homo sapiens
aagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataa

SEQ ID NO: 53014 - DNA, 387 bp, Homo sapiens
  misc_feature 161: n = A,T,C or G
gaagactgaaggataaacagaaaaatgtcattagtaccatggggtagccatgtaatgtcaagcaattttatattagccagagattcctagtaggagctacttttcttaacagatgactcagttctctttatctcaggaatgaaagagttgaagaccaatcnacaacaggggaaatgttaaggcaaaatgatgaacgtgataagggatgaattatggggtttggataaccaaacaataaaaataaaagtatagactattttagtactaaaaaggtcctgaacatgtgagcttaagtactcattttgtccccagtggctaagaaactaaaggcaagccagcaagtgtctctgagtttcagtgtctgtatgtaaaactgactctgacttc

SEQ ID NO: 53015 - DNA, 341 bp, Homo sapiens
tagacaatattcttcaattcctatacaccaacaataggcaagagagccaaatcatgaatgaactcccattcacaattgttacaaagagaataaaatacctaggaatacagctaacgatggatgtgaagaacctcttcaaggagaactacaagccactgctcaaggaaataagagaggacacaaacaaatggaaaaatattccatgctcatgggtgggaagaatcaatctcatgaaaatggccatactgcccaaggtaatttatagattcagtgctattcacatcaaactaccattgacattcttcacataattaaaaaaaactactttaagtttcatatgc

SEQ ID NO: 53016 - DNA, 370 bp, Homo sapiens
  misc_feature 27, 121: n = A,T,C or G
gcttccctggaagatattttccatgcntttggtttgtaatgcaactatttcattttccaattttaattactaaaaaggaaatttacttatagacacaggctctcttttaaaaatttagttnctttttcgcagtaaagattgagtctctagtcttgctgaaaaagtagcagatgggaataagctctctcaaattatacatcactctaggggctattgaatttcagtattggatggggtctcaggcaagcgtcactatgctctgatgcttgaaacaactccctacattatagttagcccttccacagcctgagctcctgactcacaggcactctgacatctttacgagataactgctatatttcacaactgc

SEQ ID NO: 53017 - DNA, 251 bp, Homo sapiens
tttcatagtttccatattttattactgtttattacttccatgaattttaaaatctgagggaaatgttttgtaaacatttattttttttaaagaaaagatgaaaggcaggcctatttcatcacaagaacacacacatatacacgagtagacatcaaactcaatgctttatttgtaaatttagtgtttttttatttctactgtcaaatgatgtgcaaaaccttttactggttgcatggaaatcagccaagttt

SEQ ID NO: 53018 - DNA, 331 bp, Homo sapiens
tgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcggcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctga

SEQ ID NO: 53019 - DNA, 249 bp, Homo sapiens
ataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaccaaaaaaaaaaaaaa

SEQ ID NO: 53020 - DNA, 144 bp, Homo sapiens
  misc_feature 131: n = A,T,C or G
gataaacatggaagttatgaagatgctgttcactctggagcccttaatgattgatctgatgttccttttatttataacaatgttaaatgcaattgtcttgtaccgtgagttgagtattacacattaaagtnaagtacaagctgt

SEQ ID NO: 53021 - DNA, 330 bp, Homo sapiens
agccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatgggataattttgtctctgtaccaccagttgaagggggggttgactttcgcaatgtataggataaaaaatctgatatatcaaaccatttgcatctaatg

SEQ ID NO: 53022 - DNA, 205 bp, Homo sapiens
gtctttgaaaagaatgggatctgctcacttctggtctttttggccgggaactcctgattggtgttaaggtggtaatttcccccatataagatttagaatcactgagtttgagctagatgaaatttttaaaatttctggttggctcattagactgatgaggtgagttttcttcttcatatgaacagctagttaataacagcagagt

SEQ ID NO: 53023 - DNA, 323 bp, Homo sapiens
ctgtgctcgcgctactctctctttctggcctggagactatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcatccagacttgtctttcagcaaggactggtctttctatctcttgtactacactgaattcacccccactgaaaaagatgagtatgcctgccgtgtgaaccatgtgactttgtcacagcccaagatagttaagtgg

SEQ ID NO: 53024 - DNA, 304 bp, Homo sapiens
  misc_feature 127: n = A,T,C or G
tatttgatagcacaacagggtgactagagttagtaacttatttctacaattaaaaataaccgagagtgtaactggattgtttgtaacacaagtgataaatgcttgagggaatggatactccattctntatgatgtgagtatttcacattgcatgtctctgtgtaaacatctcatgtaccccataaatatattatacctactatgtacccagaacaattaaaaataaaaaaatttaaagtacaaaaaaagacaaaaagagtcacacagaaaataaaggaaaatagtctatagaaggataaaaaac

SEQ ID NO: 53025 - DNA, 108 bp, Homo sapiens
ggaagtaaaatctgtcgaaatgcaccatgaagctttgagtgaagctcttcctggggacaatgtgggcttcaatgtcaagaatgtgtcttgtcaaggatgttcgtcgtg

SEQ ID NO: 53026 - DNA, 311 bp, Homo sapiens
  misc_feature 141: n = A,T,C or G
ggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgantatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaaatttaactccatatgtgttcctcttg

SEQ ID NO: 53027 - DNA, 116 bp, Homo sapiens
gccaatatgtaacatactctaaaagtccaaggagcaaaatttgcctgtccagctccctctccccaagaaacaacatgaatgagcaacttcagagtgtcaaacaactgccattaaac

SEQ ID NO: 53028 - DNA, 332 bp, Homo sapiens
  misc_feature 165: n = A,T,C or G
ccatgagcttatgctttagcagatactgttgttctttatgtgcctattactcactttcactttaagttatttgacagcatgtgtcactatttccagtcagtttttgatttaactaaaatctttttgtcttcaaatttatttcttttttaattttgagattttatnagagattggaaaaaagtttaagaaatagggaaggagatcatttataaaactagaaagtaatcttaatgttagtgcactgtataaacttaatataagtgataataccagtgcattagtcattattttttattacactttcaaatgacagccacctgacagaatccaaa

SEQ ID NO: 53029 - DNA, 163 bp, Homo sapiens
tagaatatattaacagaaggctgccctgcagaagttttgagttaatggtttccatcaacgcaggagtggaagaagctactggggatcaggaatcagaagtcctggctttaagccctagctttagccctcactggtaataaaatcaaagcaattggtctctttc

SEQ ID NO: 53030 - DNA, 288 bp, Homo sapiens
attgcctgacccagggactacctcaagggcttttgatgaggacaggtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaa

SEQ ID NO: 53031 - DNA, 270 bp, Homo sapiens
agaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttcgt

SEQ ID NO: 53032 - DNA, 128 bp, Homo sapiens
  misc_feature 96: n = A,T,C or G
gagcattgtgcaatacagtttcattaactccttccctcgctcctccaaaaatttgaatttttttttcaacactcttacacctgttatggaaaatgncaacctttgtaagaaaaccaaaaaaaaaaaaa

SEQ ID NO: 53033 - DNA, 111 bp, Homo sapiens
aggcttttacggggccctgtccaggtagaaaagaaatggtatgtagaacttagatttccctattgtgacagagccatggtgtgtttgtaataataaaaccaaagaaacata

SEQ ID NO: 53034 - DNA, 347 bp, Homo sapiens
aatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggccgcatcattgccaaacttcaatccaaggaatattcacagtactgaattcagtgcttagaactgaag

SEQ ID NO: 53035 - DNA, 258 bp, Homo sapiens
  misc_feature 101, 155: n = A,T,C or G
tttcatcacgttctcacacattgcgaacaacatgttgggatgggaaactggagtatccaacttgtgcaaaaagatagaatcaatcataaagtgcacacctntattcagaactttagtattaaatcagttctcaatttcattttttatgtattgtnctactcctttttattcatacgtaaaattttggattaatttgtgaaaatgtaattataagctgagaccggtggctctcttcttaaaagcccatattaaatcctg

SEQ ID NO: 53036 - DNA, 271 bp, Homo sapiens
atagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagc

SEQ ID NO: 53037 - DNA, 334 bp, Homo sapiens
tatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgccttgaattcagcctgggtgt

SEQ ID NO: 53038 - DNA, 251 bp, Homo sapiens
agagagccatgaaactggaacaggagtttactgaacatttcacagctattgtacagggggatacagctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgt

SEQ ID NO: 53039 - DNA, 229 bp, Homo sapiens
gctgttttccgcccattttattatactcttaaaagatgtaattgttgtcattttgaacagttaaacatcttgagtataaaaagaaccccaatgttatgttatgctttgtaaatttttttttttgctttgacctagataaacttctagctaatcaaataaggaaagaaactgtctttttaaagcttcttttgggtagatactgtattagagatctgcatttatcatgagt

SEQ ID NO: 53040 - DNA, 402 bp, Homo sapiens
tgataagaactcaaaggagaccgtttaaggttactaatatatattaagtacttttgattgtaagcaatagcagccatgcatgactactttaagccaaacaggaatctattggaaggaaactggaagaaatcacagatttaaaggagatggaaacagccaagacaaagtcaaagataactctgggacagtcagcagccttgggctccatataccttcaccctaaagttttaatataacttaactcccaccagtcctaggagagagaaatgcccaccaccttccaggtcagccagacttagtaaggatcaaataaagcaaacagttttggagaccctcccctgggtatcatggaatcattctcagagcaaaagcaattttgaggaaggccatcaccataaaaat

SEQ ID NO: 53041 - DNA, 420 bp, Homo sapiens
tgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgtgtgaaagtgttgaaggcacaagcacagagtcagaaagctaaataaaaaaatgaaacttttttgagtaataaaaatgaaaagacgctgtaaaaaaaaaa

SEQ ID NO: 53042 - DNA, 235 bp, Homo sapiens
ttattttttctctatcaataaagatgattttattgtcttgattctcttgctcttgatgtatttaaaaaatagatacagtgatgtgtgactttaaaattgattagttcaggccaggcacggtggctcatgcctgtaatcccagcactttaggaggccaaggtgggtggatcacctgaggtaaggagttcaagaccagcctggccaacatggtgaaactctgtcactattaaaaatc

SEQ ID NO: 53043 - DNA, 354 bp, Homo sapiens
tatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggcaacagaacaatattggaatggtggtaatacgaggaaatagtatcatcatgttagaagccttggaacgagtataaataatggctgttcagcagagaaacccatgtcctctctccatagggcctggtttactatgatgtaaaaattaggtcatgtacattttcatattagactttttgttaaataaactttg

SEQ ID NO: 53044 - DNA, 314 bp, Homo sapiens
ttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattt

SEQ ID NO: 53045 - DNA, 222 bp, Homo sapiens
aagattaagacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctacca

SEQ ID NO: 53046 - DNA, 278 bp, Homo sapiens
catataattaaatgaagataattgggatatccatcaccttaaatatttatgttttctttacactaggaacattcgaattctctttagctattttgaaatgtacaatagtttagtgttaatagatcagtcatcctactgatatatcgaacaccaggtcttatttcttctgtctacatagacatatttagaaatgcaaatctcttaggaaattaatctgtaatgtcgatgcacactgatttgaatacttgctttctttgtaggcagtatagtgaaatggt

SEQ ID NO: 53047 - DNA, 271 bp, Homo sapiens
  misc_feature 79: n = A,T,C or G
gccatgcctcggaaaattgaggaaatcaaggacttcctgctcacagcccgacgaaaggatgccaaatctgtcaagatcnagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaaaaaa

SEQ ID NO: 53048 - DNA, 326 bp, Homo sapiens
  misc_feature 178: n = A,T,C or G
gtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgnctccatgtttgatgtatctgagcaggttgctccacaggtagctctaggagggctggcaacttagaggtggggagcagagaattctcttatccaacatcaacatctcggtcagatttgaactcttcaatctcttgcactcaaagcttgt

SEQ ID NO: 53049 - DNA, 331 bp, Homo sapiens
atggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctca

SEQ ID NO: 53050 - DNA, 352 bp, Homo sapiens
gaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggacgccctttttccaggctcagaagatgtttgttgatgtaccagaaaatacagtgatctggatgagatgacccttcggcacatggtcaggattgcactgctgtaaaaactcagttactcaaactgaaacgtctcctacatcagcatgatggaag

SEQ ID NO: 53051 - DNA, 350 bp, Homo sapiens
  misc_feature 233: n = A,T,C or G
ttcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggntttgccctgcatgtcgtaacgaggagggccttttgaggccattttagtttgagttcgagccaccacctctgttggttagatgatgaataaaaaggttctgaagaaaaaaaaaaaaaa

SEQ ID NO: 53052 - DNA, 165 bp, Homo sapiens
gatggcagcatcaaaatgaagcctctgatgggggtgatatacgtgcctttaacagataaagaaaagcagtggtccaggtggaagggatttatcttctgctctttcttcttccacacatgcaagggatgaattgtaaaagcaacatcagcttgaccagtataaaat

SEQ ID NO: 53053 - DNA, 275 bp, Homo sapiens
gatagtcttttcagggtgcccattcgaatgtccagggcagatgcatcatgtttttgctcatagacggcatgagcagctgttaggacccagttgtcatataaaagtgcacctgctgctgtggttccacctaatatcaggacttgcaaggaaatcaccaggttttgccttttgccctccatatatacgccctcctgttgtgcgggctgatagtccacaaactggagaaagaagcagataggtagagagcctttgtaaaaatgtcaatcgtgttttct

SEQ ID NO: 53054 - DNA, 410 bp, Homo sapiens
  misc_feature 50: n = A,T,C or G
cacaccgggtagtttaaaacccaaacttccaaaggtttaaactacctcanaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcattggtcttgccagtctcatttcatctcttccatggtccacagagcttggttcttgggcaagcagaaaaataaat

SEQ ID NO: 53055 - DNA, 242 bp, Homo sapiens
  misc_feature 7, 30, 94: n = A,T,C or G
attatcntgatacattcaaatttgtctggntaaaaaataggtgggagatattgaggccaagaatattgcaaaatacatgaagcttcatgcactnaaagaagtatttttagaataagaatttgcatacttacctagtgaaacttttctagaattatttttcactctaagtcatgtatgtttctctttgattatttgcatgttatgttaataagctactagcaaaataaaacatagcaaatggc

SEQ ID NO: 53056 - DNA, 301 bp, Homo sapiens
  misc_feature 73, 87, 225: n = A,T,C or G
gtaagttacttgacaagcctcagcaaacccaaagatgttaacagtattttaagaagttgctgcagattccttngccactgtatttgntaatttcttgcaatttgaaggtccgagtagaggtttaaagaaaaatcagtttttgttcttaaaaatgcatttaagttgtaaacgtctttttaagcctttgaagtgcctctgattctatgtaacttgttgcagactggngttaatgagtatatgtaacagtttaaaaaaaaagtggtattttataagcacagacaattctaatggaacttttgga

SEQ ID NO: 53057 - DNA, 228 bp, Homo sapiens
  misc_feature 120: n = A,T,C or G
aacacaggtagttacaaaaacatgttattgtactgtgtaaagatgcatagtcatctcatttggttggctttgtaccttgtaccttttttagccttggcttttgttgaactagaaccctcntcacatactgtgttgtacttttgtaaatgattttttaaatggaattttgcacataatacattgtaatactgtatgataatcatgtgtgaaaataatttttgaaatacc

SEQ ID NO: 53058 - DNA, 327 bp, Homo sapiens
tttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgctatttggaatggactgaatgaggaggtctctccagccagaaggagtattgaggtcatcaggcctcagaaaacaatgtacacataatctcgg

SEQ ID NO: 53059 - DNA, 361 bp, Homo sapiens
  misc_feature 180: n = A,T,C or G
gctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctgganagattacagatataataaccatgttgctatgggggagagacgctgcattccagaaacgtcttaacacttgagtgaatcttcaaaggccctgacattaaatgctgaggctttaatacacacatattttatcccaaggttataatggtggtctgaacaaggcacctgtaaataaatcagcatt

SEQ ID NO: 53060 - DNA, 269 bp, Homo sapiens
  misc_feature 119: n = A,T,C or G
atgctatccgtcaggccatctccaaagccctggtggcctattaccagaaatatgtggatgaggcttccaagaaggagatcaaagacatcctcatccagtatgaccggaccctgctggtngctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaaaaaaa

SEQ ID NO: 53061 - DNA, 295 bp, Homo sapiens
gcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgggctcaaaaataatatacttttacattaaagaaatttaatgtttctctggagttggggctcttggctttcagagtttggttaatcagtgt

SEQ ID NO: 53062 - DNA, 314 bp, Homo sapiens
aaagaaagctgcttgtgtttgctttgttaattgccccaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttggttccctttttgaaacaagt

SEQ ID NO: 53063 - DNA, 309 bp, Homo sapiens
aaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacgggccctcttttggtggatgtagcacaattt

SEQ ID NO: 53064 - DNA, 108 bp, Homo sapiens
  misc_feature 60, 75: n = A,T,C or G
gactcccagtataattgtacctaaagtatttataaacagctcatcggagcctctatttgncatagacttttgagntgattgttgggaccacataataggaccattttt

SEQ ID NO: 53065 - DNA, 100 bp, Homo sapiens
  misc_feature 4, 15, 30, 31, 35, 36, 51, 56, 62, 69, 84: n = A,T,C or G
tggncgggatgaccnacaaggcaaaatgannactnncagatcaagaaattnggacnctaganctggtcnatatagtgagacctntaaaaaactgaggtct

SEQ ID NO: 53066 - DNA, 327 bp, Homo sapiens
cttagaatttaaaaaaagcttcaaagaaatctaataagcatatgagcctttctactattttttggtttattttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattgggggga

SEQ ID NO: 53067 - DNA, 393 bp, Homo sapiens
  misc_feature 7, 9, 249, 324: n = A,T,C or G
gagtgcnanatcttcagagaagaatttctctttagttctttgcaagaaggtagagataaagacactttttcaaaaatggcaatgggtatcagaattcctcaagcagcctggtttattgaaaatgaagagcaggaatatgttcaaactgtgaagcatccaaaggtggcccggatcagcggtgagcccctatcctaccttcaatccatcctcggatgtcgctgcttgcataaggccataatggttaaaggngtggatgaagcaccatcattgacattctaactaagcgaaacaatgccagcgcaacagatcaaagcagcatatctncaggaacaggaaagcccctggatgaaacactgaagaaagcccttacaggcaccttgaggaggtggttta

SEQ ID NO: 53068 - DNA, 100 bp, Homo sapiens
  misc_feature 6, 13, 31, 35, 37, 71, 79, 88, 98, 99: n = A,T,C or G
ccgganagtcccnctactgaataagcgtagnagtntnatgtttaccatgtgagtcctgcgacactaaaganatttcgantatcagtcntgatggcaanna

SEQ ID NO: 53069 - DNA, 234 bp, Homo sapiens
  misc_feature 4, 14, 28, 41, 61, 65, 66, 71, 75, 113, 114: n = A,T,C or G
gcgncatagccgcnaagattaaagtganagaccttggccanagccatattctagattattncagnnagacnctcnaatacaatcttttgattttaagaataaaaatatgcttnnattttgggatgagagttgtgacgttttcccttgtaggtcttaaatctccagggacactaatgaaatgtgtatgaaaacaagatagaaatcagggccagttatctgtgacaatccaccccc

SEQ ID NO: 53070 - DNA, 388 bp, Homo sapiens
  misc_feature 55: n = A,T,C or G
ccgaaaagaccgatctggagaaggacattatttcggacacatctggtgacttccncaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaaggaaagaggtaaaggagacctggaaaatgctttcctgacctggttcaagtgcattcagaacaagcccctgtatttgctgatcgcttgtatgactccatgaag

SEQ ID NO: 53071 - DNA, 333 bp, Homo sapiens
  misc_feature 5, 37, 60, 293: n = A,T,C or G
aaatncatctatcccaattgagacagctagaaacagntgactgactaaatggaaactagnctatttgacaaagtctttctgtgttggtgtctactgaagttatagtttacccttcctaaaaatgaaaagtttgtttcatatagtgagagaacgaaatctctatcggccagtcagatgtttctcatccttcttgctctgctttgagttgttccgtgatcacttctgaataagcagtttgctttataaaaacttgctgcctgactaaagattaacaggttatagtttaaatttgnaattaattctaccatcttgcaataaagtgacaattgaatg

SEQ ID NO: 53072 - DNA, 289 bp, Homo sapiens
cacttaagtgtctggcccgcaatactgtaggaacaagcgtgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgtttt

SEQ ID NO: 53073 - DNA, 354 bp, Homo sapiens
tgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaataccaatagaagggtaatgc

SEQ ID NO: 53074 - DNA, 210 bp, Homo sapiens
agactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatgtaaaaaaaaaaaaaaaaaaaaaaaaaaaa

SEQ ID NO: 53075 - DNA, 311 bp, Homo sapiens
atttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtt

SEQ ID NO: 53076 - DNA, 319 bp, Homo sapiens
tagtgtccacatccagatcagctgtaaaatggggaagacgtgtgctgatttggaatgaatgcaaaatatcactatcattttcctaattacagaggagcaaaggttatcttcagccctttcagttctatgctcacatattcaaatatcaaatgtaatttagctgaagttatttaataatcaagtctttcaatatctgttcaaagaaaaagaacacactttgaaaattctgcaaagctgtctcccagtctttaaaatgtctggaagcactctccttctttacaataccaacatcactggcccagaatcttccctgtgctag

SEQ ID NO: 53077 - DNA, 396 bp, Homo sapiens
  misc_feature 2, 3, 119: n = A,T,C or G
gnnccttccgagaaccggccttttggccgggagagacgcaagagaaaaatccactgccttccaaagaaacgattgaacaggagaagcaagcaggcgaatcgtaatgaggcgtgcgccgncaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctgg

SEQ ID NO: 53078 - DNA, 377 bp, Homo sapiens
  misc_feature 4, 11, 147, 163: n = A,T,C or G
ccgngttctcnggtcctcaagagacttggatttaaaggtgtatggaagggactgtttgcccgtatcatcatgattggtaccctgactgcactacagtggtttatctatgactccgtgaaggtctacttcagacttctcgccctcctncaccacgagatgccanagtctctgaagaagaagcttgggttaactcagtagttagatcaaagcaaatgtggactgaatctgcttgttgatcaagtgttgaagaaagtgcaaaaggaacttttatatatttgacagtgtaggaaattgtctattcctgatataattactgtagtactcttgcttaaggcaagagttcagatttactgttgaaataaacccactcttcatgc

SEQ ID NO: 53079 - DNA, 400 bp, Homo sapiens
  misc_feature 3, 4, 43, 59, 119, 165, 180, 232, 248: n = A,T,C or G
ccnntggacagattgctgaccaggggcttgagagctggggatntattttccctcctcanactgactttgcagccacggaggaggcaggggaaatggaaggagatgcagtcgaagccatngtggaggagtccgaaacttttattaaaggaaaggagagaaagactnaccagagacgccggnaagggggccaggaagaagatgcctgcacttaccccagaaccagacggatggnggtgaggaggccaggntgtcaacagcagcgtacagatggtgatgatggaacagctggaccccacccttcttcagatgaagactgaagtaatggaggcacagtgctccagaagcagagctgctgtggacgatcccagattataacttacaggttgtaaatatggaggac

SEQ ID NO: 53080 - DNA, 362 bp, Homo sapiens
  misc_feature 21, 24, 29, 30, 33, 35, 48, 301, 350: n = A,T,C or G
cttttttgaaaccacatcagnagnaaccnngantntaaaatgaagtgncaagacgaaggcgaaacctgagcagttcctaaaaagatttgctgttaagaaattttctttgtgcagtcatttattaaggattcaactcgtgatacaccaaaagaagagttgcttcagagatgtgttccatgctctctagcacaggaatgaataaatttataacacctgctttagcctttgttttcaaaagcacaaaggaaaagtgaaagggaaagagaaacaagtgactgagaagcttggtaaggaatcaggntttttctacctggtaaacattctctattcttttctcaaaagattggtgnaaggaaaaaatg

SEQ ID NO: 53081 - DNA, 263 bp, Homo sapiens
  misc_feature 3, 50: n = A,T,C or G
ggnaccatctgcatggaggatttgattcatgagatctatactgttggganaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaac

SEQ ID NO: 53082 - DNA, 254 bp, Homo sapiens
  misc_feature 42: n = A,T,C or G
aataccaaaatacttaggaatatatctaaccaaggaggtganagatctctaccatgaaactacaaaacattgctgaaagtaatcctagatgacaaaagcaaatggaatcacatctcatgctcatggatggctagaatcaatattgtgaaaatgaccatgcttgcaaaagcaatctacagattcaatgcaattcccactaaaataccatcatcattcttcacagaactggaaaaaaaaatcctaaaattcacatg

SEQ ID NO: 53083 - DNA, 397 bp, Homo sapiens
  misc_feature 3, 9, 107, 143, 248, 253, 277, 305: n = A,T,C or G
cgnagaganccgctgatcgcagagctgcggaagatgaatgccagaggacttggatctgagctaaaggacagtattccagttactgaactttcagcaagtggaccttntgaaagtcatgatcttcttcggaaagggtttttctngtgtgaaaaaatgaactttgcctagtcatccccttgaattatcagaaaaaaattccagctcaaccaagataaaatgaatttttccacactgagaacattcagggnctatntgctccgctaaaattacagatggnattcaaggcagtgcagcaggtcaagcgncttccatttctttaagctcaaatctttcactggatgttttgaggggaatgatgagactattggatttgaggatattcttaatgatccatcac

SEQ ID NO: 53084 - DNA, 397 bp, Homo sapiens
  misc_feature 55, 292, 299, 334: n = A,T,C or G
cggaggtggccagggccagagctttttggtctgatttacaaattaatgaagtagnttcaaacaacgcggcatgtttacctctccatttgggagcctgcctacattcttgttctagaagcacaaaaaatcctcagatgaattaagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgcttgnagatgcnagagagaagctataggaaacccagtccacccctgnctgtctgcgagacatcggtcataaggcacagcacatcgcaagatgaacagttggtaataaaag

SEQ ID NO: 53085 - DNA, 306 bp, Homo sapiens
  misc_feature 35, 48, 60: n = A,T,C or G
agaaactgggttcgggccggaattctgaatcaganattaatatgtatngctaaatgactngacatgcattgccatttaattgggggaacaaaaggcctcaggtaaggatgaggaactctgaaatcagatggaaaagagcggtgttaattttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccacc

SEQ ID NO: 53086 - DNA, 331 bp, Homo sapiens
  misc_feature 2, 5, 325: n = A,T,C or G
tnctntcctttgcagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttaagaatgaaggcttncagaag

SEQ ID NO: 53087 - DNA, 359 bp, Homo sapiens
gaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgccttta

SEQ ID NO: 53088 - DNA, 385 bp, Homo sapiens
  misc_feature 286: n = A,T,C or G
acaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggntaaaaatcacatcaaaaagctactaaaaggactggtgtaatttaaaaaaaactaaggcagaaggcttttggaagagttaagaagaatttggaaggcctt

SEQ ID NO: 53089 - DNA, 437 bp, Homo sapiens
  misc_feature 24: n = A,T,C or G
agcaatcagactgtcgacattccngaaaatgtcgacattactctgaagggacgcacagttatcgtgaagggccccagaggaaccctgcggagggacttcaatcacatcaatgtagaactcagccttcttggaaagaaaaaaagaggctccgggttgacaaatggtggggtaacagaaaggaactggctaccgttcggactatttgtagtcatgtacagaacatgatcaagggtgttacgctgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttggtcaagtatctcaagcccagaaagatgaattaatccttgaaggaaatgacct

SEQ ID NO: 53090 - DNA, 424 bp, Homo sapiens
  misc_feature 17, 49: n = A,T,C or G
catccagcaatgagagntcctgctctgtagaccaacatccagtgtgatnttgtgctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggtccatttaaaaatcatctttttatatgtgcttcggtctagacttcagcttttggaaattgctaaatagaattcaaaaatctctgcatcctgaggtgatatacttcatatttgtaaccaactgaaagagctgtgcattataaaatcaggtagaataggtagaacaattcttatttatgcccacaacca

SEQ ID NO: 53091 - DNA, 414 bp, Homo sapiens
  misc_feature 120, 380: n = A,T,C or G
gaatgacaaacggttcctaagaccccatctgatgctggcagagggccagcctcctcattcctgcttgctcttagaaaatctttcactgatcattttttgtcactggaataacttcaaggntattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgcactgttaaaccctttttgggataaagccaaatgtaaatgaaaacattaaacagataaattgtggngttgagacttttctgaattgagaaaaataaatga

SEQ ID NO: 53092 - DNA, 397 bp, Homo sapiens
  misc_feature 18, 309: n = A,T,C or G
ttcctccggaaccatgtntgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgncctgcctttcccatctgtctatctatctggctggcagggaaggaaagaacttgcatgttggtgaaggaaagaagtgggggtggaaaga

SEQ ID NO: 53093 - DNA, 208 bp, Homo sapiens
gggacatattacaactgacaccacagaaatgcaaaaggtcattcaagggtactatgaacacctttatgtgcataaactagaaaacctacaggagatggatacattcctgaaaagatacaaccttcctagcttagatcggaaagaattagatattctgaacagaccaaaaacaagcagcaagattgaaatgataattaaaaaattacca

SEQ ID NO: 53094 - DNA, 299 bp, Homo sapiens
  misc_feature 200, 257: n = A,T,C or G
tgcatatttaattttgtcaaagctgagaaatgctcatgagttgaatttataaatgtcatttgcaaccaaatgaagtatttatttttaaaaagagagtgaaggaaccaacactgatttgtacataataaaaatgtgtgtattatatatatatattttttcctccttgacagtacttggcacaatatcaagtgtatttttgnacataatatatattgattagaaaaacgcaattgctattcaaaaaattctatctctgngatagatatatttatcctaatctggtggaacctctgtaattt

SEQ ID NO: 53095 - DNA, 465 bp, Homo sapiens
tctcccagaaggaaatttggcaatgctggaagaggatggatggactcaaatctgtaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggatagtctctaggagttttattaatagtaaaggtaaaatccctcagtttcctacctctaggaaagaggcatctcactagaatagggatattatgcatactgagctagaccagaagagctgggacaaaataaa

SEQ ID NO: 53096 - DNA, 447 bp, Homo sapiens
  misc_feature 74, 380, 417: n = A,T,C or G
gacctaatccaagcatccctttgcccagaaagaagatgggggaggaggcagtaataaaaagattgaagtatttngctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgacttttgcatttaaagcagacactggcatggatataggtttactttaaaactgggnacataactgaaaatggctatactgcatacttttaaantggaaagatattttatcttatatgaagaaa

SEQ ID NO: 53097 - DNA, 444 bp, Homo sapiens
  misc_feature 337: n = A,T,C or G
atggccggatgggtagatacatatcacatctcaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagaagcttgtaaagccaaaactgatgctggcggtgaagatgctattttgcaaaccagaacttatgacctttacatcacttatgataaatattaccagactccacgattatggntgtttggctatgatgagcaacggcagcctttaacagttgagcacatgtatgaagacatcagtcaggatcatgtgaagaaaacaggtgaccattgaaaatcaccctct

SEQ ID NO: 53098 - DNA, 354 bp, Homo sapiens
  misc_feature 56: n = A,T,C or G
gagccctttggagaacgccagtttcccaggccccctgcatctatcgagtttgcaangtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggagaatagtttaggagaaaccagcttttactgtttttgaaaaattacagcttcaccctgtcaagttaacaaggaatgcctgtgccaataaaagg

SEQ ID NO: 53099 - DNA, 365 bp, Homo sapiens
  misc_feature 306, 327: n = A,T,C or G
ggaggcccagcctggtgatgaggaatagcaaggagagaattcagctccagttcaaaagcctacaaaatctgagactgtcattgcttttataaggattccagctttccctcctggccagaaatgttcagcctggactcattcagaaaagcatccctggatgtgaatgaggaccctccttaaacaggaatggagaggttgagctggtcatttccaaccttagcttcaaggcagaactggaattagtttcaacataaaccttgatcctaggcacttagttctagaagatcctacaagcacgtctgctgnaactctatgtatggtttccgnaaaatcacatacctataaaataaaaagaaaaaaatcgc

SEQ ID NO: 53100 - DNA, 346 bp, Homo sapiens
atcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacgaaaaaaattgtattgaaaacacttagtatgcagttgataagaggaatttggtataattatggggggtgattattttttatactg

SEQ ID NO: 53101 - DNA, 386 bp, Homo sapiens
taggacaaagtgagatgtgctatcaatgtaagatacataccagattttgaagactagtattaccaaaagaatgtaaaatatcacattaataattttatattaattacatgttcaaatgatattttggatatactgaattaaaacattaaaattagttctacttgtatctttttacttttttaatgtggctagaagaaaataaaattatacatgtggctcagattatatttctattggacagcgctgtctagaacattatattaagtggttattattgaagtagaccaaagttataccataaggatatttttccttaaataccatgttgaagacaattatttattgatccttgaatctgtaagacaaatacaagtctctatccatgt

SEQ ID NO: 53102 - DNA, 450 bp, Homo sapiens
  misc_feature 245, 252, 361: n = A,T,C or G
ttaagtgaagatatttcttcagctctggggaaaatgccacagttttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgngttctgntaatacctctgagtgtcctacctccttggagatgagatagggaaggagcagggatgagactggcaatggcacagggaaagatggggcttttgggatggtttatttctgnaacactggggcctggggggggctggggaagcccctgcatcccatggaccctggaattggggacagcaaaagccagaaccatgagtatga

SEQ ID NO: 53103 - DNA, 104 bp, Homo sapiens
  misc_feature 84: n = A,T,C or G
aggctgaggcagagagaatcactggaacccaggaagcggagggtgcagtgagctgaggtcgtgccaccgcacttcagccggggngacagagcgagacagtctct

SEQ ID NO: 53104 - DNA, 324 bp, Homo sapiens
  misc_feature 16, 38, 39, 84, 87, 96, 155, 211: n = A,T,C or G
tgattgcacattgttncaaccctcctaacaactagggnngccaaaatataaacggactctcctgataccacattctccttcagnagngcttcactngacaaggtcctgctaagtattatcagaaaatccacccagcttcaccattactgcgacgnctgaggctggagaaaatgatgaaactgtccagactaccctcaagtttacatacagngaaaaatacccagatgaagctcccctttatgaaatattctcccaggaaaatctagaagataatgatgctcagacattttaaaattactagcattacaggctgaagaaaatctt

SEQ ID NO: 53105 - DNA, 323 bp, Homo sapiens
  misc_feature 21: n = A,T,C or G
cagaggacgataagcactgcngcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagcatcccagcaatcgcttggtcaagtttcattcagctctctatggaccaagtaatctgataaataaccgagctcttctttggggatcaatatttattgactt

SEQ ID NO: 53106 - DNA, 151 bp, Homo sapiens
  misc_feature 18, 28, 29, 31, 44: n = A,T,C or G
tcagactgcagcaaccantattcctgcnntnactgacctgaagntcactcagggcacacccacaagcctgagcgcccagtggacaccacccaatgttcagctcactggatatcgagtgcgggtgacccccaaggagaagaccggaccaatg

SEQ ID NO: 53107 - DNA, 420 bp, Homo sapiens
  misc_feature 75, 97, 317, 388: n = A,T,C or G
gaaccaatggatttcaaaatcaacaccgatgagattatgatttcactcaagtctgttaatggacaaatagaaagnttcattagtcctgatggttctngtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtntggagagccatggatgggtggttttcagtttagctacggaaatcccgaacttcctgaagatgccttgatgngcagctggcattccttcgacttctctccagcc

SEQ ID NO: 53108 - DNA, 251 bp, Homo sapiens
  misc_feature 195, 203: n = A,T,C or G
aatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggngacatcgntatgctctgctttattttttctttcttacccacttagcttcctaattg

SEQ ID NO: 53109 - DNA, 113 bp, Homo sapiens
  misc_feature 35, 77: n = A,T,C or G
taatcaaagacgtcttggataaattccttaattgncatgagcaaacatatgatgaagaatttctgaacacttttacncatctttcacaagaggatcatgtgtccaaaagggga

SEQ ID NO: 53110 - DNA, 170 bp, Homo sapiens
  misc_feature 5, 10, 32, 34, 39: n = A,T,C or G
acagnggatnctcctccttcatcctgtaaagntnaacantaaaaaccaaattatggggctgcttttgtcacactagcatagagaatgtgttgaaatttaactttgtaagcttgtatgtggttgttgatctttttttttccttacagacacccataataaaatatcatatt

SEQ ID NO: 53111 - DNA, 370 bp, Homo sapiens
  misc_feature 12, 17, 79, 80: n = A,T,C or G
caccatgcggancaccnatattaacacgctgcctggcctgtctggatcccgaggtatggcagaggtgcaagacctagtnntctttcctctaactcactgcctaggaggctgccaaggtgtcctgggtcctctagcccactccctgcctacacacacagcctatatcaaacatgcacacgggcgagctttctctccgacttcccctgggcaagagatggggacaagcagtcccttaatattgaggctgcagcaaggtgctggctggctggccatttttctgggggtaggatgaagagaagcacacagagattctggatctcctgctgcttttctggagtttgtaaaattgttcctgaatacaagcctatgc

SEQ ID NO: 53112 - DNA, 400 bp, Homo sapiens
  misc_feature 2, 11, 57, 59, 60, 64, 65, 110: n = A,T,C or G
gncgggacccngagagagccacaggacttgtgaatgaaatccacaggcaaggtttgngnnggannccttttgcaatattgggagggaatgccaaaccctatgtttgctgnggaaaagagtatggtagttcctcaaaacatcaaaatggtattgccttatgattcagcagacccacatcccaagacagcaaaagaattgaaagcagagtcttgaaaaaatatttgcacatccatgtttgcagcagcattattggcaatagctaaaacgtagaagcaattgaactgtccaacaacagatgaatggatgagcaaaacatgatatatacatacaatggaaaattattcagccttaaacgagggaaatattctgacatatgttgcaacttggatgaaacttgagg

SEQ ID NO: 53113 - DNA, 395 bp, Homo sapiens
  misc_feature 1, 10: n = A,T,C or G
ncgaaaactnctaaaacttccagttcttcctcccaagctcactttatttaatgctaaatacaacaaaatcaagagtaggggaatcaagagcaaatgcattcaaaaaaccgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggacaacatataaatg

SEQ ID NO: 53114 - DNA, 396 bp, Homo sapiens
  misc_feature 4, 12, 33, 39, 43, 47, 66, 67, 79, 313, 314, 347, 348: n = A,T,C or G
ccgngatacgcnaaaatggaccacagtggactnatttgnaggntgtnagttgccctgctacctagnntgttagtgcatntgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttggttaactagactgcgnntggttttcccgtataataaaaccaaagaatagnntggtcttcaaatcttaagagaatccacataaaagaagaactatttttt

SEQ ID NO: 53115 - DNA, 393 bp, Homo sapiens
  misc_feature 7, 56, 139, 164, 170, 172, 231, 386: n = A,T,C or G
aatgccngggatataaattagtttttattattctcttaaaaatcaaggatgatctntatcactttgccacctgtttgatgtgcagtggaaactggttaagccagttgttcatacttcctttacaaatataaagatagcngtttaggatattttgttacattttngtaaantnttgaaatgctagtaatgtgttttcaccagcaagtatttgttgcaaacttaatgtcattntccttaagatggttacagctatgtaacctgtattattctggcggacttattaaaatacaaacagacaaaaaataaacaaacttgagtctatttacctgcacatttttggtgtacagtgaaaaaaatggtccaagaaaatggttgccattttgcantgtttcg

SEQ ID NO: 53116 - DNA, 340 bp, Homo sapiens
  misc_feature 6, 8, 37, 41, 51, 60, 74: n = A,T,C or G
agacgntngaagagaaggagagcctgcaagacagagncctncagcttgttntgtgtcccnacctgtaccagcanctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagc

SEQ ID NO: 53117 - DNA, 374 bp, Homo sapiens
  misc_feature 38, 57, 61, 92, 146: n = A,T,C or G
atgcctttactctttatcagtaataaattatgactgtnttcatattgccttagggcnatcnccctgtgtaaaccattgtcttttgttttggntttctttagcattatgaagctttggtattgtacaaggtcaggtagtaagatgcncactagtctcagggcttgtgtaatattctgggaggcatttaaatgccagaaatggtcaagcaattatacacagtatttatgactctgttaagcataccgttgctgcacattagtagattctgagattaaaaaaaattttaaagagggatcatttaaataatttctaaaagggtcttttcaagctctaacaaagcactaacaaatgcattatttctacagaattagatg

SEQ ID NO: 53118 - DNA, 342 bp, Homo sapiens
  misc_feature 6, 18, 30, 60: n = A,T,C or G
catgcntggcagcggcanaggcggaaaagncttggggaagggccggagctaagcgccatngtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgcacctatacggagcacgccaagcgcaaaactgtcacagccatggatgtagtatatgccctaaaacgtcaggggcgcactctgtatggcttcggcggctgaatctaagaatacgcggtctcctgagaact

SEQ ID NO: 53119 - DNA, 397 bp, Homo sapiens
  misc_feature 2, 10, 397: n = A,T,C or G
gnagaacccnacaggttcatctttatttatagttcacaagcaacccaatggacatgcctggaagagagctcaatgaggacagagacagtggcatagcacggtctggtaatgtcacgttcttgtattcagttttttatgagattactgttggcattgattttctttttatccctccctttattatcaaatttgttcatattgatattagccttacaagagaactgtgaaaagaccagagcaaagtcttataaatttaatatttttcatgtttacttttaagtgtgctaagtagggataaagccaggatgaagtaaagccagagtaaagtacactggttgaagcttagtgaatataagaagaaaagcattggtcagaaaaactgcttagaaactgtagn

SEQ ID NO: 53120 - DNA, 400 bp, Homo sapiens
  misc_feature 7, 9, 381: n = A,T,C or G
gacacgncnacacttgaaaaagtatcagatattctcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagcttcttaacccggattactgtaaatgtttgcaaaaatgaatatgcttttccttaaaaaatgaaaactttaatttttaccatccatttatgtttaagatacaaaacttatttccatgtttctgaatcttctttggttcaaatggngctgcatgtttcaactaca

SEQ ID NO: 53121 - DNA, 396 bp, Homo sapiens
  misc_feature 5, 7, 50, 51, 83: n = A,T,C or G
ggagncnttgaggcagccagcgcaggggcttctgctgagggggcaggcgnngcttgaggaaaccgcagataagtttttttctntttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgcggaggttgagatgaagcttcttcatggagtaaaaaatgtatttaaaagaaaattgagaggaaaggactacagagccccgaattaataccaatagaagggcaatgcttttaagattaaaatgaaggtgacttaaacagc

SEQ ID NO: 53122 - DNA, 344 bp, Homo sapiens
  misc_feature 1, 5, 30, 37, 49, 76, 77, 94, 97: n = A,T,C or G
ngacnaaggaaaactcactaccatgagaanatgcagnggatttgcttgntgcctcctaggcatcacctgtgccatnncagttaaacaggctgantcnggaagttctgaggaaaagcagctttacaacaaatacccagatgctgtggccacatggctaaaccctgacccatctcagaagcagaatctcctagccccacagaatgctgtgcctctgaagaaaccaatgactttaaacaagagacccttccaagtaagtccaacgaaagccatgaccacatggatgatatggatgatgaagatgatgacgaccatgtggacagccaggactccattgactcgaacga

SEQ ID NO: 53123 - DNA, 342 bp, Homo sapiens
  misc_feature 7, 10, 27, 31, 32, 39, 50, 54, 63, 67: n = A,T,C or G
agatgangtnaatcatgacccgagagntgcnnacaaatnacttgaaagangtgngcaataaantgantccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagtcagacttcaaatagtggcaaataaaaagtgctatttgtgatgc

SEQ ID NO: 53124 - DNA, 360 bp, Homo sapiens
  misc_feature 35: n = A,T,C or G
agccagcgcaggggcttctgctgagggggcaggcnggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtgagatgaagcttcttcatggagtaaaaaatgtatttaaaagaaaattgagagaaaggactacagagccccgaattaataccaatagaagggcaatgcttttagatta

SEQ ID NO: 53125 - DNA, 400 bp, Homo sapiens
  misc_feature 3, 4, 324, 336: n = A,T,C or G
cannacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaataggaagagcgagtacagcaagtacgcaagaaattggaagaagcacttgatggcagacatcttgtcgcgagctgcttgatacagaagagatggatantgaaatggcagnggagatgaagcctaagaatatgatcaggtaactttcgccgctttccccaagagaaaattcctag

SEQ ID NO: 53126 - DNA, 400 bp, Homo sapiens
  misc_feature 3, 4, 54, 59, 215, 333, 365, 382: n = A,T,C or G
cgnnggagccgttattgtttattgggtacagtatttcagtttgggatgatgaanaattnctgaaggtgaataatggcagtggcttggcaacagcacaaatgtacttaatgccactgaattgtacacttgaaaatgggtaaaatggtaagttacatgtatatatatatattttaccaccataaaaagtctcccaacaccagcctaccagttatagntggcactataaacagcttcttttatagccatctagatagggctatgcaaatacaagcatagatatgcgagtataagcatactgtcaatgcataagatatgcgagtataagcatactgncaatgctcattccttggagcactcatgtaggngccaggtatttcccagngacaaaactgacaagggt

SEQ ID NO: 53127 - DNA, 257 bp, Homo sapiens
  misc_feature 9, 15, 33: n = A,T,C or G
ccccagtgncggagnccataccactcatggatntggaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaag

SEQ ID NO: 53128 - DNA, 210 bp, Homo sapiens
  misc_feature 14, 90: n = A,T,C or G
ctaacaattctacnccaaatcgtttcttcaaatacgtatggactggataactctgagaaacacatctagtataactgaataagcagagcntcaaattaaacagacagaaaccgaaagctctatataaatgctcagagttctttatgtatttcttattggcattcaacatatgtaaaatcagaaaacagggaaattttcattaaaaatatt

SEQ ID NO: 53129 - DNA, 250 bp, Homo sapiens
atcatcttccaagttggcaagtaactcccaatgatttagtttttttccccccagtttgaattgggaagctgggggaagttaaatatgagccactgggtgtaccagtgcattaatttgggcaaggaaagggtcataatttgatactgtatctgttttccttcaaagtatagagcttttggggaaggaaagtattgaactgggggttggtctggcctactgggctgacattaactacaattatgggaaatgc

SEQ ID NO: 53130 - DNA, 260 bp, Homo sapiens
  misc_feature 60, 75, 125, 140, 157, 216, 242, 244: n = A,T,C or G
atgtatgaatgtctacgtgttgctaacgaagtcactcttaattaatatctgtatcctggnacaatattttatggntatgtttttctgtgtgtcagttttcatagtgtccatattttattactgtntattacttccatganttttaaaatctgagggnaatgttttgtaaacatttattttttttaaagaaaagatgaaagggcaggcctattttcntcacaagaacacacacatatacacgnantagacatcaaactcaa

SEQ ID NO: 53131 - DNA, 170 bp, Homo sapiens
  misc_feature 157: n = A,T,C or G
atgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcactttttttttngtcttcaaattcc

SEQ ID NO: 53132 - DNA, 300 bp, Homo sapiens
  misc_feature 99, 104, 148, 204, 231, 275: n = A,T,C or G
ggcattgaggcagccagcgcaggggcttctgctgagggggcaggcggagcttgaggaaaccgcagataagtttttttctctttgaaagatagagattantacanctacttaaaaaatatagtcaataggttactaagatattgcttancgttaagttttttaacgtaatttttaatagcttaagattttaagagaaaatatgangacttagaagagtagcatgaggaaggnaaaagataaaaggtttctaaaacatgacggaggttgagatgaancttcttcatgggagtaaaaaatgta

SEQ ID NO: 53133 - DNA, 390 bp, Homo sapiens
taagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttgggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaagg

SEQ ID NO: 53134 - DNA, 279 bp, Homo sapiens
  misc_feature 22, 164: n = A,T,C or G
gttcatccggcaccagttcagnaccgatatgtcaaaattaagcgtaactggcggaaacccagaggcattgacaacagggttcgtagaagattcaagggccagatcttgatgcccaacattggttattggaagcaacaaaaaaacaaagcacatgctgcccaggnggcttcccggaagttcctggtccacaacgtcaaggagctggaagtgctgcttgatgtgcaacaaatcttactgtgccgagatcgctcacaatgtttcctccaagaaccgcaaaag

SEQ ID NO: 53135 - DNA, 180 bp, Homo sapiens
  misc_feature 62, 116, 124, 130, 148, 151, 165, 173: n = A,T,C or G
gacttctgagagtcgagtactcctatgttgaagactaccaagctcgtgttcaagggaaccanaggcgaagaggcgaggatggaaaagaaagtatcaagggagtgaagctgaagccncttgcccnttgagnaacccctcttcgaggggnctngggctcattgaggnttgccagnaataagt

SEQ ID NO: 53136 - DNA, 360 bp, Homo sapiens
  misc_feature 9, 30: n = A,T,C or G
tattacagncactgtccgcatcaacttgcngaaagaaatataaatgacatttcaaggatagaagtatacctgattttttttccttttaattttcctggggccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaaga

SEQ ID NO: 53137 - DNA, 360 bp, Homo sapiens
  misc_feature 22, 164, 201, 253, 286: n = A,T,C or G
ttgatgacatctgattagcagnaagtcatgttccagcttggactcatgaaggattaaaaatctgcatcttccactattttcaatgtattaagagaaataagtgcagcatttttgcatctgacattttacctaaaaaaaaaagacaccaaatttggcggaggggnggaaaatcagttgttaccattataaccctacagaggnggggagcatgtaacatgagcttattgagaccatcatagagatcgattcttgnatattgattttatctctttctgtatctataggnaaatctcaagggtaaaatgttaggtgttgacattgagaaccctgaaaccccattccctgctcagaggaacagtg

SEQ ID NO: 53138 - DNA, 391 bp, Homo sapiens
  misc_feature 298: n = A,T,C or G
attcttcccctctctacaaccccactctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgngtctttcctgtcctgcatcgccatgatgtgtaacgaattctttgaaggcttcccagataagcagcccaggaagaaatgaaaactcctctgatg

SEQ ID NO: 53139 - DNA, 283 bp, Homo sapiens
tgtgtgttctttctccaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctcaaaaaaaaaaaaaaaaaa

SEQ ID NO: 53140 - DNA, 400 bp, Homo sapiens
  misc_feature 1, 86, 141: n = A,T,C or G
naattgtagggtaatacccacaacaacctgtagtttcttacttggccaagagaatgcttatttaagtgttagacttccattctggnaaaatcttgccttatcagaagacattggaaagagggattccctttggtgtttggncttctacttagaaaaacctattgcagtgtagtttatcttgtagtattcatctttgtattctgaagataaggtttgaattaaattgatacacacagaggggaaccgattttttttatccaatgtggaattataaatgagataatccacagttattcattgtggagttgttgagactatgaaagactcattgtctttgtattcagctcttaaatagtgtaactatatccccacctctgcttgctttctttccctcccctcc

SEQ ID NO: 53141 - DNA, 100 bp, Homo sapiens
  misc_feature 98: n = A,T,C or G
gataagccttcggcagattaaaacactggaactgacaattaacagcccaatatctacaatcaaccaacaagtcattattaccctcactgtcaacccanca

SEQ ID NO: 53142 - DNA, 176 bp, Homo sapiens
ctatagttgtagcacatggagaaagcaaatgtaaaactggataagaaaattatttcggcagttcagccctttccctttttcccactaaattttttcttaaattacccatgtaaccattttaactctccagtgcactttgccattaaagtctcttcacattgggaaaaaaaaaaaaa

SEQ ID NO: 53143 - DNA, 200 bp, Homo sapiens
  misc_feature 159, 161: n = A,T,C or G
ttcctcccttttcttgaccctccccttttttcttctattaatcaagagaaacttcaaggttaatgggatgggcggatctcacaggctgagaactcgttcacctccaagcatttcatgaaaaagctgcttcttattaatcatacaaactctcaccatgangngaagagtttcacaaatcccaaaaaaaaaaaaaaaaaaaa

SEQ ID NO: 53144 - DNA, 270 bp, Homo sapiens
  misc_feature 17, 146, 148, 159, 171, 201, 209: n = A,T,C or G
accgtcctctttttccntcataattctaatctaacaatgggaaggattgtgcccatttacacttttgaggactttttgggggatgtaaataaccccatttctttgcttgaacacagtattttcccaatagcactttcattgccagngnctttctttgangcctttcctggncagcattcttagcctgtggcaataaagagnaactttgngctacatgacgacaaaactgctaaatctcctattttttttaaaatcactaacattatattg

SEQ ID NO: 53145 - DNA, 364 bp, Homo sapiens
tgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattac

SEQ ID NO: 53146 - DNA, 282 bp, Homo sapiens
  misc_feature 167, 220: n = A,T,C or G
attgaggacaaggctggtatgggtggcagaaagaagatgtttgaaggcgaagccgcctaaattcctggacatttctttaattagttgttgtaggaattctacagagctgcgcattcacagatcttttttttttattttgcaatagttttgtcttctctgctttcagngcctcaattaagcatttgttgtatgcagcatgcacatcctgaaaaagaactgngtgtcatcaaagagccactaccattaaatcaatgcttttgagaaaaaaaaaaaaaaaaaaaa

SEQ ID NO: 53147 - DNA, 223 bp, Homo sapiens
atttagccacaccactaagcaaagagacctttagtttaaagccccgaatccaggtgagctaccccgagacagcctatttaacttagggccaacccgtctctgtggtaatagagtgggaagagctccgggtagaagtgacagacctatcgaacctggcaatagctggttgtctgggagatgaataaaagttcagcttcgtacaccccaaaaaaaaaaaaaaaaa

SEQ ID NO: 53148 - DNA, 400 bp, Homo sapiens
  misc_feature 126, 127, 130, 325: n = A,T,C or G
cattctctgccaagaccaaaaggaaagaagaaaaagggccaaaagccaaaatgaaactgatggtacttgttttcaccattgggctaactttgctgctaggagttcaagccatgcctgcaaatcggnngtnttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgngattccttgcaacaatcaatgagaatcttcatgtattctggagaacaccattcctgatttcccacaaactgcact

SEQ ID NO: 53149 - DNA, 357 bp, Homo sapiens
  misc_feature 46: n = A,T,C or G
agaaaattccaaattgagggacgtattttaaaataacagtcttgtnatcttcaaaagtgttaaggttatgaatgtcaagggaggcctgataaactgtttcagattgaggaagaagagacatgacaactaaaggcagcttgtgatcctgaactagatcattttgctatcaaaaacatgatgggtacatttgccaaaacttgagtggttgtaatgtactgatgcgaatttactgattttgatgtttatattttagttatgtaggagaatgttcttatttgtaagaaaatacactacaaagaaagatgggacatcaagacaacaaattactctcaaaaaaaaaaaaaaaaaaaaaaaaaa

SEQ ID NO: 53150 - DNA, 490 bp, Homo sapiens
agtgtttaaaagtggtcatatttattactgactttgagtcaggtgttaaaatagcagtgccacagctcgcctcttgccttagtgtgctgctgtgagagtcacagtggaaactgcaaggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtatttttgtaca

SEQ ID NO: 53151 - DNA, 410 bp, Homo sapiens
  misc_feature 34, 193, 194, 212: n = A,T,C or G
gaagacttccttcttgacaaattgtgtttttagngaatttcttaaaccgttttatttagccctccttccctctttctagttggaagccaaatgtactcatgaaaacagccactcctattctgagtcttggtttcttcacctagaaagtgagggtttggactaggatgagtggctttcagggtgttctggtgannctcctcatgaatacttangggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtagggccaattatcactttaccaattaagag

SEQ ID NO: 53152 - DNA, 353 bp, Homo sapiens
  misc_feature 195: n = A,T,C or G
atagaaagagtaagttgctaagccttgtaggagcctatctcctgctccagcacctgcctgggactgaagatacaagaaggattcagtttaaaattatgaggtgggtgtatcacaaggtcaggagtttgagaccagcctggccgacatggtgaaaccccgtgtctactaaaaatacaaaaattagccgggcatggngacacactcctgtaattccagctactcaggaggctgaggcagaagaatcacttgaaccagggaggcagaagttgcagtgagccaagatcgcagcactgcactctagccctgagtgacagagcaagactctgtcttgggaaaaaaaaaaaaaaaaaaaa

SEQ ID NO: 53153 - DNA, 204 bp, Homo sapiens
aatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagacgaaaaaaaaaaaaaaaaaaaaaaaaa

SEQ ID NO: 53154 - DNA, 153 bp, Homo sapiens
  misc_feature 33: n = A,T,C or G
gaagatagaagtttggagtggaaaactggaagnacagaagtacgggaaggcgaagaaaagaatagagaagatagggaaattagaagataaaaacatacttttagaagaaaaaagataaatttaaacccaaaaaaaaaaaaaaaaaaaaaaaaa

SEQ ID NO: 53155 - DNA, 300 bp, Homo sapiens
  misc_feature 49, 81, 102, 105, 108, 123, 126, 138, 150, 168, 197, 205,213, 220, 267, 281, 285, 297: n = A,T,C or G
aggcattgaggcagccagcgcaggggcttctgctgagggggcaggcggngcttgaggaaactgcggataagtttttttctntttgaaagatagagattaatncanctncttaaaaaatatagncantaggttactaanatattgcttagngttaagtttttaacgtanttttaatagcttaagattttaagagaaantatgaggncttagaanagtagcntgaggaaggaaaagataaaaggtttctaaaacatgacggaggttganatgaagcttcttcntggngtaaaaaatgtnttt

SEQ ID NO: 53156 - DNA, 400 bp, Homo sapiens
  misc_feature 36: n = A,T,C or G
acttcctacatatgtacaaaggcgacaagaatggtncactgcagcactgtctataattttaaaatatcaagactaaatgcccatcgaaaaagaagaggtaaataaattttaatgtctttatactgtggagtaaaattgggcagttcagaagaacaaagtagagctgtgtatgaatataaatttcaaaagcaacattgagcagaagagttgcagaattatagatatcatctaatactatttgtacaaagttggaagacatacaaaagaatacatgcattgtttatgaatacacaggtagtaatagtgtaagacattcatgggatgaaaactacaaatttgggataatgataaccctctttagaagaaagaaagggagtaggattccagaacattccttggg

SEQ ID NO: 53157 - DNA, 400 bp, Homo sapiens
  misc_feature 19, 25, 49, 67, 181, 397: n = A,T,C or G
gggcttcctttgaagaganactcanaaccattttgaaactgcttagttnagaatacatcgaaggttnaaaattactgagttgggtaatttactatcatttactttttacattacaagtgcaataatatttcacaaaatgaaactcccgaatgggtggagtatgtgattattggtacctggnccttctggggctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgngat

SEQ ID NO: 53158 - DNA, 336 bp, Homo sapiens
aggaaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacgattactgacctatgctctaaaacatgaatgctttgttacagacccaagctgtccatttctgtgatgggttttgaataaagtattccctgtcttaaaaaaaaaaa

SEQ ID NO: 53159 - DNA, 420 bp, Homo sapiens
ttttcagcaaattccgatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaaatgatgttatacatcaatatgtatatatggtatttctatatagacttggagaatactgccaaaacatttatgacaagctgtatcactgccttcgtttatatttttttaactgtgataatccccacaggcacattaactgtgtgcacttttgaatgtccaaaatttatattttagaaataataaaaaggaaggatacttacat

SEQ ID NO: 53160 - DNA, 420 bp, Homo sapiens
atcaataaattagttcaagctaagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacatttgaagttaaacacaaaattatcagtgttttagaaacatgagtccggactgtgtaagtaaaagtacaaacattatttccaccataaagtatgtattgaaatcaagttgtctctgtgtacagaataca

SEQ ID NO: 53161 - DNA, 378 bp, Homo sapiens
  misc_feature 3: n = A,T,C or G
aancgatttatctagaaaaatggcatttttctcccgtgactttcgtcttggatttggctcatacgttgataaaacagtttcaccatacattagcatccaccccgaaaggattcataatcaatgcaggtatctagggtttgatgtagatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcacccaaaaaaaaaaaaaaaaaaaaaa

SEQ ID NO: 53162 - DNA, 320 bp, Homo sapiens
tccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgacctaaaaaaaaaaaaaaaaaaaaa

SEQ ID NO: 53163 - DNA, 420 bp, Homo sapiens
  misc_feature 24, 71: n = A,T,C or G
tgtagaaggagtgacttccaaggnaatggctacccaacttgccttcatgcgcctggtggaaactatgcctntcagaacatcacctaccactgcaagaacagcattgcatacatggatgaggagactggcaaccctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaa

SEQ ID NO: 53164 - DNA, 217 bp, Homo sapiens
  misc_feature 31, 46: n = A,T,C or G
agaagcaagtggccatggggagcctcagcgntctgcgcctggaagnagaaagctgtttttaggttatgtgaaagagatgtttcctcatctctaaggcttaccagaagctctgatttgaagagaataaatggattttgcacaaaaccacagggaaagtcccgggagctccattcccgcacttacaacagagtgcctttacacaaacctacgggttggg

SEQ ID NO: 53165 - DNA, 410 bp, Homo sapiens
cataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaagtatctttctcttacctgttatttatcaatttttcccagtatttttatacggaaaaaattgtattgaaaacacttagtatgcagttgataagaggaatttggtataa

SEQ ID NO: 53166 - DNA, 420 bp, Homo sapiens
  misc_feature 379: n = A,T,C or G
agacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgttttgtgttaaaatttgcagcagagccttgagaaaagtacattggnctgggaattttcatcattaacattttataatcttacactca

SEQ ID NO: 53167 - DNA, 400 bp, Homo sapiens
aaggtgttggaactcgccataaggcattgatcaggattatggtttcccgttctgaaattgacatgaatgatgtcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaa

SEQ ID NO: 53168 - DNA, 400 bp, Homo sapiens
agatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgc

SEQ ID NO: 53169 - DNA, 420 bp, Homo sapiens
  misc_feature 411: n = A,T,C or G
ctgacagtaattcagaagcaggaaaaaaagccttttaaaaataccgaggaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatgggaaaatttgcccttgttgcaacatacaattgcaaaagatgagtttaaaaaaattacatacaaacagcttgnattatattt

SEQ ID NO: 53170 - DNA, 124 bp, Homo sapiens
aagctgaagcaggagaatcacttgaacccgggaggcagaggttccggtgagccaagattgagctactgtactccagcctgggtgacagagcaagactgtgtctcaaaaaaaaaaaaaaaaaaaa

SEQ ID NO: 53171 - DNA, 370 bp, Homo sapiens
  misc_feature 55, 92, 116, 299: n = A,T,C or G
tcaaaacatgattctttatcacctgacaccaggagttttcattggaaaaggattngaacctggtgttacctaacattttaaagaccacacangggagcaaaatctttctgaaagangtaaatgatacgcttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggnagcaccttcaaagaaatccccgtgactgtctatatcccaggacccacactaacaaaagacaaaattgaagg

SEQ ID NO: 53172 - DNA, 370 bp, Homo sapiens
  misc_feature 44: n = A,T,C or G
tcctccgctgtatccctgggttcttgcaagtcggccaggatgtntcaggctgagtttgagaaagctgcagaggaggttaggcaccttaagaccaagccatcggatgaggagatgctgttcatctatggccactacaaacaagcaactgtgggcgacataaatacagaacggccccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttcta

SEQ ID NO: 53173 - DNA, 160 bp, Homo sapiens
  misc_feature 118: n = A,T,C or G
cccgctgcctttagaatgaaggtcttcccagaagccacatccgcacaatttttccacttaaccaggaaatattttctccctctaaatgcatgaaatcatggtgggagatctctattgnaaatctctattgggggattacaattgattaaaatcaataaat

SEQ ID NO: 53174 - DNA, 317 bp, Homo sapiens
aaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggggattttgaataccattaaaactg

SEQ ID NO: 53175 - DNA, 450 bp, Homo sapiens
aatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataattttatttccctaatatcaggaaatccccagttgtctatgtggcccagtgcttaaaaacgccttcttgcatgaggggattgaacta

SEQ ID NO: 53176 - DNA, 520 bp, Homo sapiens
tcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaaggatgttcgtcgtggcaacgttgctggtgacagcaaaaatgacccaccaatggaagcagctggcttcactgctcaggtgattatcctgaaccatccaggccaaataagcgccggctatgcccctgtattgggattgccacacggctcacattgcatgcaagtttgctgagctgaaggaaaagattgatcgccgttct

SEQ ID NO: 53177 - DNA, 460 bp, Homo sapiens
tttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagat

SEQ ID NO: 53178 - DNA, 460 bp, Homo sapiens
cagcgttttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatacctgtggagaggacttccaaatgtggttaccctcagctatatcactgcccaacatcagaaaacctgacggctatgattactatgccttttctaaagatcaatactataacatttgatgtgcctagtagaacagcaagagcaattactactcgttctgggcagaccttatc

SEQ ID NO: 53179 - DNA, 280 bp, Homo sapiens
  misc_feature 18, 25, 72, 131: n = A,T,C or G
tttctgttattattccangactggngataggccgggctaaaaaggtattattatttttcctttaatgatggngctaaaattcttcctataaaattccttaaaaataaagatggtttaatcactaccattgngaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcga

SEQ ID NO: 53180 - DNA, 400 bp, Homo sapiens
  misc_feature 123: n = A,T,C or G
acagcccctgatcaactaagttttgtggtacttcaccctcttctgccctcatttgatgtgacagccattgtgagactgatgcacaaactgtcacttggttaatttaagcacttctgttttcgngaatttgcttgtttgtttcttcatgcctttacttactttgtcccatgctactgattggcacgtggcccccacaatggcacaataaagcccctttgtgaaactgttctttaaatgaaacacaaggaaattggccactggtaaaactctgcagcttcaactgtacttcatttaatgccattaatgcaaatatacttcctcttctttttgcatggctttgcccacctctgcaatagtgataatctgatgctggaagatcaaataaccaatataaagcata

SEQ ID NO: 53181 - DNA, 158 bp, Homo sapiens
cgtggtggcacggagtctgtaatgccagctactcaggaaggctgaggcagaagaattgcttgaacctgggaggccgttgcagtgaactgagatcatgccactgcactccagcctgaactactgggcaaaactctgtctgaaaaaaaaaaaaaaaaaaa

SEQ ID NO: 53182 - DNA, 190 bp, Homo sapiens
  misc_feature 5: n = A,T,C or G
aaganaaaatttgaaatctggttaggctggtgttagggttctttgtttttggggtttggcagagatgtgtttaagtgctgtggccagaagcggggggagggggggtttggtggaaattttttgttatgatgtctgtgtggaaagcggctgtgcagacgttcaattgttatcaaaaaaaaaaaaaaaaaaa

SEQ ID NO: 53183 - DNA, 240 bp, Homo sapiens
  misc_feature 7, 24, 46, 68, 80, 115, 116, 126: n = A,T,C or G
tcctgangctgacagaattacggnccgaggtgtgtcgctccgtggncttagctgtgctcgtgctactntctctttctggnctggaggctatccagcgtactccaaagattcaggnntactcacgtnatccagcagagaatggaaagacaaatttcctgaattgctatgtgtgtgggtttcatccctccgacattgaagttgacttactgaaggatggagagagaattgaaaaagtggagc

SEQ ID NO: 53184 - DNA, 124 bp, Homo sapiens
  misc_feature 9, 13, 28, 37, 38: n = A,T,C or G
actggcgtncacnacagcagcagtggtntggaaatgnntccctcgggtgacatgtcagatctttgaacgtaattaaaaatattgtggcaggattaatagccaaaaaaaaaaaaaaaaaaaaaaa

SEQ ID NO: 53185 - DNA, 228 bp, Homo sapiens
ataccgtagaaaagatggcgtgtttctttattttgaagataatgcaggagtcattagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccattaaaaaaaaaaaaaaaaaaaa

SEQ ID NO: 53186 - DNA, 375 bp, Homo sapiens
  misc_feature 331, 346: n = A,T,C or G
aaaggagtaggggtatagcttgggtcccttttcctgcaaggccccatggggcagaatataataaatattctgagtgaggagtgtggactttttctgatcttcctcagcttccgtaagttgcagagtgaggtatattagggagactagttctacacaatattgtaatgccgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagnaatatattggtatgnttttctaaattaaaaaaaaaaaaaaaaaa

SEQ ID NO: 53187 - DNA, 381 bp, Homo sapiens
  misc_feature 14: n = A,T,C or G
ttccatctgatatnactgtggctcagttcatgtggatcctcaggaaaaggatccagcttccttctgaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaacctggatttatttcttaatatatttgggaaggggtttggtttccttagactagcaaaaaaaaaaaa

SEQ ID NO: 53188 - DNA, 127 bp, Homo sapiens
tgtactaaaaaactgggtaaagtgcaggaggcggagcttgcagtgagccaagatcgcgctactgcactccagcctgggcgacagagcgagactccatcccaaaaaaaaaaaaaaaaaaaaaaaaaaa

SEQ ID NO: 53189 - DNA, 280 bp, Homo sapiens
  misc_feature 69, 71: n = A,T,C or G
tttcaaagtgtcactaccttgaaccaccgccagatggctatgagaatgttacaaatactgcgccaccantntaatgctttctcagcccaaggcatgccagaggtaaaataaaatacatttgtaacccaagtctttaaatggttcttttgctatataaaacctgtatagaggactaaaaccaaggaaattaggtgaatcattcatgcggattcattgtttgatattcagtgctatgaaaacctcatccctcaaatttaaaaaaaaaaaaaaaaaaaaaaaa

SEQ ID NO: 53190 - DNA, 460 bp, Homo sapiens
  misc_feature 22: n = A,T,C or G
gaaaaaatgcttttaatttttnacagccgagaaacagtgcagcagtatactgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtattttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggggttttcactcctgtccagtctatttattattcaaataggaaaaattactttacagggtgggtttactgtagcttataatgatactgta

SEQ ID NO: 53191 - DNA, 400 bp, Homo sapiens
  misc_feature 76, 161, 253, 375, 379: n = A,T,C or G
aaatatggggaattcaggtactgtttgccatgatgtgccttaacaactccctttgactatcatcaatgctattgtngttcatgggaaataattctaatgtgggttttagtctgttaattaattttaaaaacatgaatagtgaaggtttgtgtcaggagtcncaaagtagtatttaagctgctgaacctgcagtctgttttgtaccatcaggtgagagtgagagccaagtgggaggtctttctggaccaatggngtgcaaaatactcagtcttcctttctttttttcctatgtcttatcagtgaagaagtgatggatggttgtgggaataaattatgttgtaagtacctgggatttgtaaggattagtatttttgnatgnatttatatagatgctggtaag

SEQ ID NO: 53192 - DNA, 293 bp, Homo sapiens
  misc_feature 10, 11, 44: n = A,T,C or G
ataactgaannaaataacttgctggctatataggaaaatgctgnggaaatgaactgtgtatatactttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggt

SEQ ID NO: 53193 - DNA, 186 bp, Homo sapiens
  misc_feature 7: n = A,T,C or G
tgtactnaacctttgtgtacacaagtgtaaaatactccccactgtactgttagaggccaacaattctagtatggcttgttggcaaagagcgctacaccgtttcaatgaaacaatgtatgtttgttttaactgaactaaaataaatacatgcttaatcctgcaaaaaaaaaaaaaaaaaaaaaaaaa

SEQ ID NO: 53194 - DNA, 158 bp, Homo sapiens
  misc_feature 27, 33, 48, 57, 73, 85: n = A,T,C or G
tcctgcggaaagtgtctttgtctcccnttgganaaaaggaaccaaccnacaaaacantgccctcacttggaantttcccaccgcntttgtgaagccgtgtcgtatgaacctaagtaaaacttttgtacaaaaaaaaaaaaaaaaaaaaaaaaaaaaaa

SEQ ID NO: 53195 - DNA, 406 bp, Homo sapiens
  misc_feature 7: n = A,T,C or G
accagtnagaccgatatgtcaaaattaagcgtaactggcggaaacccagaggcattgacaacagggttcgtagaagattcaagggccagatcttgatgcccgacattggttatggaagcaacaaaaaaacaaagcacatgctgcccagtggcttccggaagttcctggtccacaacgtcaaggagctggaagtgctgcttgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagcctcatgtgcacgttttctgtttaaataaatgtaaaaaactgacaaaaaaaaaaaaaaaa

SEQ ID NO: 53196 - DNA, 500 bp, Homo sapiens
attttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttact

SEQ ID NO: 53197 - DNA, 440 bp, Homo sapiens
  misc_feature 1: n = A,T,C or G
nctctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtaagagaagctggatgtatacatctaccaagaaataattcttgctaatcacttcaatgaaggaggagcagcccagctgcagtttgatatgactcggaatcttttccctttgttttctcactattgca

SEQ ID NO: 53198 - DNA, 220 bp, Homo sapiens
  misc_feature 41, 60: n = A,T,C or G
caaacaagctgtatataaacagtacaatgaaactctttgcngagttggaaattaaaaggnaagagagagaagccaaagagatgcctgaaaggaaacgacaatagggaagaagagattgaagctcaagaaaaagccaaacgggaaagagagtggcagaaaaactttgaggaaagtcgagatggtcgtgtggacagctggcgaaacttccaagccaatacga

SEQ ID NO: 53199 - DNA, 450 bp, Homo sapiens
  misc_feature 20, 37: n = A,T,C or G
tcttatgtatcttctgcttnctgacagcttctttttnaaataacatgccaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatattgatttc

SEQ ID NO: 53200 - DNA, 460 bp, Homo sapiens
  misc_feature 22, 53, 65, 68: n = A,T,C or G
cgggcaatgtaggaaataggtnaattgtaattgtgaaaaaataattttaaggnaatcttacaagnatnacattaaaaagaatactatgactgccacctgccatttaccttctaataaccctgccatgtggtttgcaggaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgacagattgaccacgggaatactactgccatgtaatctgtataggtccagataatttgtcatgaacattgacagaatga

SEQ ID NO: 53201 - DNA, 353 bp, Homo sapiens
  misc_feature 8: n = A,T,C or G
aacaaaantaaaatctgtggtcgtctgaggtattctccctgctataacccagtttagctgatgcatttggagcttgggtgctgaaattaaatataacctatttgagttaaggatttattactagtgctccagtggtcacaggaacaataaaaaaggaacaacgatagaaatacgtgatctaggaaagaaggcaactgaaaaacctgaaagaaaaaaaatgaaagattaaaagtatacgatattctattttgatttagcaattacttgttttctagtgttctgtcaatttttggtgacttttataattacattaaaactaagatgctggttaaaaaaaaaaaaaaaaaaaaaaa

SEQ ID NO: 53202 - DNA, 303 bp, Homo sapiens
  misc_feature 98: n = A,T,C or G
gtctcgaatgtaattggaatcttcacctcagagtggagttgaaactgctttagcctaagcggctgtttacttgctttttccttagcagttgctcacantgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttaaaaaaaaaaaaaaaaaaaaaaaaaaaaaaaaaa

SEQ ID NO: 53203 - DNA, 480 bp, Homo sapiens
taagtgtaatgtctttgtgaaaagtgatttttactgccaaattctaatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacatagtcttaattactataactggataagtcttgaaatcaggtaggagtaagt

SEQ ID NO: 53204 - DNA, 500 bp, Homo sapiens
acaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctc

SEQ ID NO: 53205 - DNA, 120 bp, Homo sapiens
  misc_feature 28, 52, 65, 74, 99: n = A,T,C or G
tccacgagccgtgggccttgcgaaatgntcaagcctttctttcattccctcnctgaaaagtattncaacggggnattccttgaagaatatgtggatcanctgtcaaagccttgcttcaga

SEQ ID NO: 53206 - DNA, 530 bp, Homo sapiens
ttatggtcgcggggaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggccaaatgaaggtgaattcaaggctgaaggaaatagcaaattcacctacacagttctggaggatggttgcaccgaaacacactgggggaatggagcaaaacagtctttgaatatcgaacacgcaaggctgtgagactacctattgtagatattgcacccta

SEQ ID NO: 53207 - DNA, 500 bp, Homo sapiens
  misc_feature 205: n = A,T,C or G
ataggaactatataataatagcttttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgnaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatac

SEQ ID NO: 53208 - DNA, 400 bp, Homo sapiens
ataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattgggtctctattagtcttgtggg

SEQ ID NO: 53209 - DNA, 460 bp, Homo sapiens
  misc_feature 43: n = A,T,C or G
accctattattatttagaaataaaacaacatctgagcatatcntaaaactgctaaaaatgaaactcaaaaagaaaatcttaaatctgaagtaaccctagaaggaaattagatgtgcttccttcaaagagcaaaataagactgatagttaactgtgtaacaaaatatttcctcaaagtgccaaagaaaaataattgccaacctagaaatcaatatctaatcaaggtattcttcacagtaaaactaaatgcagatatacactatagagactacaaaagagaaggtaaataaatcccacagagaaggatacagatgcaataaggaacgaaaaacagtggaaagagtaaatatatggggtaaacctaaataaatctgactgcataacacaacagttatgtcttagactgttttgaatataaacagatttaaaattcaaaaaagaacagcataaaagcaggagag

SEQ ID NO: 53210 - DNA, 125 bp, Homo sapiens
tctacggttcttaaacctcatctgttaagttcccatgcctggagaagctaatgccaactcatcatgtgataattcaatttgtacaataaattatgaacctgaaaaaaaaaaaaaaaaaaaaaaaa

SEQ ID NO: 53211 - DNA, 301 bp, Homo sapiens
  misc_feature 41, 57: n = A,T,C or G
aaagttcagtgagtcaagtgggcccctttcacctaaaaaantctctctgtaatctantgtaaaatatataacgtgcatcattacatgtaatatatcaaataattcagtttctcctggtagtctaaatttgtggtttaacagttccactagtatttcaattaactattatttcctcacactaagttcccaagtatgcatagacataggaaccttgtgattcaaaattttggttttaattgtaaaaacaggtcttggctgcaaagagaataaaaaagccatgccaaaaaaaaaaaaaaaaaaa

SEQ ID NO: 53212 - DNA, 370 bp, Homo sapiens
  misc_feature 34, 40: n = A,T,C or G
tttactggttgcctggaaatcagccaagttttcnactccntaaatcttaatgttcctcaaagcttggattaaatacctatggatgttactctcttgcaccaaattactcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcgaaaaaaaaaaaaaaaaaaaaaaa

SEQ ID NO: 53213 - DNA, 319 bp, Homo sapiens
ctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgta

SEQ ID NO: 53214 - DNA, 350 bp, Homo sapiens
agatgttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagttaagtttaaaagttgtagg

SEQ ID NO: 53215 - DNA, 240 bp, Homo sapiens
aagggatagcaagtgtaggttgattcataattcttggtataaaaccaagttttccttagtcttgaggaatttgaagaaaggtaaaatgttggattttaagcaaagtaggattgaccagagactgttctgactttgacattcagacctttcagatgtcttccttcagaccagccaagacactcggcatttccagccaagttgcttttttttctgccaataaagtattcattagttgacgtt

SEQ ID NO: 53216 - DNA, 317 bp, Homo sapiens
taaggggccctgcaaaagccagtgagctataccatacacaaaatatgtgaaccctgaaggacagaaaacaattcaagccttgaaaagaactgagaattattaaaaattttatttcccaaagccagcaaaggcttttataagtttaatactattctaaagagtagctctgagaggaggcggccccaatccagtttgggaaaaaaaaaagttcagagatgttttgaaaatgcctaccgttttatttattttttttaaatagcaccaacctaaaaaacaagtgtttcccataaacggtgatttacacagaacggaaaaag

SEQ ID NO: 53217 - DNA, 216 bp, Homo sapiens
tgatctttttaagtttccttccctacccagtccccattttctggtaaggtttctaggagggctgttaggtgtacatcctgcagcttattggcttaaaatgtactctccttttatgtggtctctttggggccgattgggagaaagagaaatcaatagtgcaactgttttgatactgaatattgacaagtgctttttgaaataaagaaccagccctcc

SEQ ID NO: 53218 - DNA, 338 bp, Homo sapiens
tgtcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgcacggcctgagcgtccagaaatggtgctcaccatgctttcagctaacaggtctagaaaaccagcttgcgaataaca

SEQ ID NO: 53219 - DNA, 237 bp, Homo sapiens
gactgagtctgttcacttcaccccaaagtaattctatcaatactgttggtttggtatgacccagtttcaggttcattcttctcaaagcagtcttgccatttgactcttcgctcattgtcatgtttttagaaactctaaatattcactgtcccgaagtgtgacacatgagacattatcaacagaatttaggaaataatttaatatgatgctgcactgtctaacattcttgcttaagag

SEQ ID NO: 53220 - DNA, 349 bp, Homo sapiens
  misc_feature 108, 341: n = A,T,C or G
tcttttatattgtttcctactaatgtcattatattacacatttattctacaaatgtttgttctatacatgtgtactgagcactactatgtgttagggctatccttggngcttgaggacactgcagtgagcaaaacaaaaatgtctgcattcagagagtgtacattgtagagaattgcactagccactaggagtatggcaatgcaaatgaaatacccaagcgctcagtcatagatattcctctgtactgctcagttgcacgtgatcttttagggcaccatgttattggagactgcaggcatttactctcttcattgtgagtcctccgcctttccacttgagngcacatct

SEQ ID NO: 53221 - DNA, 189 bp, Homo sapiens
aaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttt

SEQ ID NO: 53222 - DNA, 382 bp, Homo sapiens
aagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccaacaagaataaaaaagaaatccatatcttaaagaaacagctttcaagtgcctttctgcaggttttcaggggcgcaagatagatttggaataggaataagctctagttcttaaca

SEQ ID NO: 53223 - DNA, 313 bp, Homo sapiens
tgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagattttgagactgcagcctattaataaaggtaacataacttaaaaaaaaaa

SEQ ID NO: 53224 - DNA, 284 bp, Homo sapiens
tagaaacatatttcatggaaaacattaataccattttgttattgaaagactagataatctacaaataatcccatgaaaagagcaaattttctgaaaaatatataaacctgttaatataataaacaagatagcactcaaatgtatttgcaaaattaatatataataactcagtaaaatgtaattatattgtaccttacttaaatatattttatgacatcaaaattatttttctctcccattaaaattagaaataaacaaaaaagttaatcaaaatcttaactatt

SEQ ID NO: 53225 - DNA, 345 bp, Homo sapiens
ggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttaggtacagtgggttttattgtttttgtgactgaaggatttattcaggctgctgtactcttcatttgatgtaacaaaatgctattaatctaaatatttgtaaataaaggacctgtatctagattaaactaaaaaaaaaaaaaaa

SEQ ID NO: 53226 - DNA, 354 bp, Homo sapiens
cgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgggaaaatggctgggcggtgtaagtctgctttgaccctcgacatggatcacacaatattaaaaaaaaagcctggtacctcattgcaat

SEQ ID NO: 53227 - DNA, 324 bp, Homo sapiens
tgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggtaccctattgaataggtcagaagtagaatcttttcatcatcacagaaagttctattggacagtgctcttctagatcatcataagactacagagcacttttcaaagctcatgcatgttcatcatg

SEQ ID NO: 53228 - DNA, 335 bp, Homo sapiens
tgttcagaaaaactgacttctttagacatgagacgaaattcagaaaactaagactcctgatgatatggattttgatgttgcacaataaaatccttctcattctgtggagtctactgctcgatagtcagactgttttctgttcatatcaagtaaagcctgcctattggggcaaatagagttcagaattcccccttaagggaggaggcctcccccaaaatatgccaactgacacgagtggaggagaacagttcccactctcctggtgttactatcttaaagacacataaccaagaggtcatggagtacatgaggagaattgacagtgtgaaagaaaa

SEQ ID NO: 53229 - DNA, 244 bp, Homo sapiens
aaaccgcagacaagatattttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaaaaaaaaa

SEQ ID NO: 53230 - DNA, 178 bp, Homo sapiens
gccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaattg

SEQ ID NO: 53231 - DNA, 365 bp, Homo sapiens
tgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaagccgcgcctgcctttcccatctgtctatctatctggctggcagggaaggaaagaacttgcatgttggtgaaggaagaagtggggtggaagaagtgggg

SEQ ID NO: 53232 - DNA, 362 bp, Homo sapiens
gctcacctgcaccccctctctgatccgagctggatccagagttacatacagaccaatttctgcatcagtgtcatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaacagcagctgttctcatatgctatcctgggatttgccttgtctgaagctat

SEQ ID NO: 53233 - DNA, 336 bp, Homo sapiens
ctagtttccattcttaaaaataaatctctacaaattatctagcaaaaaattgtgccatccctaaaacaagaaatcaaatggctaataaacatgaaaaatattcagccttgctagtaattaaaaaattcaaactacagtaagatagcccttgtcattgtcagattgacaaagatttaaaagtatccagggatagtatggcaactacaaaaggtgtaactggacacataatgggagtaccagatggaggagaaacagagaaaagaagaaatatttgaagcaataattattgagaatttttccccaaattaatgtcagataccaagccatagattcagg

SEQ ID NO: 53234 - DNA, 282 bp, Homo sapiens
aaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgccttataaaaaaaaaaaa

SEQ ID NO: 53235 - DNA, 338 bp, Homo sapiens
tctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaga

SEQ ID NO: 53236 - DNA, 276 bp, Homo sapiens
acaggtactgctttatgtttatcttctctctacttcaaccaaaatcagatctttgaggttttgctgacattgttggtggttttgcacatgttctttctaattggatttatgaatagttctatgggttttcaaagatgaatcatgctaagaacacttctgctttttgatccactgtttgcagcagaattatatatatgtataggaaaaatccactttgaataatccatgttttgtatttggaaattggttttaaaaataaaaaggaaaggaaatata

SEQ ID NO: 53237 - DNA, 392 bp, Homo sapiens
aaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaacctgaccaagtaaaggataaattcaaaaaatagcctcatgagac

SEQ ID NO: 53238 - DNA, 315 bp, Homo sapiens
ggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagg

SEQ ID NO: 53239 - DNA, 312 bp, Homo sapiens
tacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaatcctgtcttgttcataaattgacaatgtcaataaattgaaatatggt

SEQ ID NO: 53240 - DNA, 180 bp, Homo sapiens
catctggtaagggccttcctgctgtcatcccatggcagaagggcaatggaggcacacacatccttttatagtgaacccactcagatgatagtgacattaatccccacactcatcacccttaccacgctactcctacctatctccccttttatactaataatcttataaaaaaaaaaaaaa

SEQ ID NO: 53241 - DNA, 356 bp, Homo sapiens
catgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtgctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagg

SEQ ID NO: 53242 - DNA, 184 bp, Homo sapiens
  misc_feature 105: n = A,T,C or G
atgctctcattgcttttatatttttaaattgtagcttttagagacctatgatcctcatggaacttaattttttattaaatattcaggtaacagttctgaattcangtgataatggtggcattatatatgattaaacacttcagaactttctaatgttatcaggagtattttgagggagatatga

SEQ ID NO: 53243 - DNA, 310 bp, Homo sapiens
  misc_feature 50: n = A,T,C or G
atattaaatcaggaaaaaaaaatgcagggaggtatttaacagctgagcanaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgt

SEQ ID NO: 53244 - DNA, 254 bp, Homo sapiens
  misc_feature 78: n = A,T,C or G
aaaaccccagacgccatgaaagctgccatggcctggagaaaaagctgaaccaggcccttttggatcttcatgccctgngttctgcccgcacggacccccatctctgtgacttcctggagactcgcttcctagatgaggaagtgaagcttatcaagaagatgggtgaccacctgaccaacctccacaggctgggtggcccggaggctgggctgggcgagtatctcttcgaaaggctcactctcaagcacgactaa

SEQ ID NO: 53245 - DNA, 157 bp, Homo sapiens
gtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaaccc

SEQ ID NO: 53246 - DNA, 325 bp, Homo sapiens
atgcgtggccttctgccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaaca

SEQ ID NO: 53247 - DNA, 163 bp, Homo sapiens
aaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 53248 - DNA, 355 bp, Homo sapiens
ggagtgatgttagcagacccagcttagagttcttctttctttcttaagccctttgctctggaggaagttctccagcttcagctcaactcacagcttctccaagcatcaccctgggagtttcctgagggttttctcataaatgagggctgacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtagga

SEQ ID NO: 53249 - DNA, 366 bp, Homo sapiens
aagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaaaaaaaaa

SEQ ID NO: 53250 - DNA, 229 bp, Homo sapiens
aacaattttttaattctttatctttttctgcatatatttaggtgactaccacaaagaaaaataaacctctaccggcattgacccatagtaccctgccacacatttttttacctgcctattttgttaacatcagtcaggcatgcttgtttgaggttatctcagcaccaaattgggagggatcaaaaacccaaaaactttgcttctacagctgctgtaaccagggaaaatt

SEQ ID NO: 53251 - DNA, 138 bp, Homo sapiens
catggcgcctgtaatcccagctactcaggaggctgaggcaggagaatcatttgaacccaggacgcagaggttgcagtgagccaagatcacgccaccgcacaccagcctggtcaacggagcgagacttagtctcaaaca

SEQ ID NO: 53252 - DNA, 305 bp, Homo sapiens
gaacagagaccagaaagagtaaaaccttttatgacaggggctgcagaacaaatcaagcacatccttgctaatttcaaaaactaccagttctttattggtgaaaacatgaatccagatggcatggtgctctattggactaccgtgaggatggtgtgaccccatatatgattttctttaaggatggtttagaaatggaaaaatgttaacaaatgtggcaattattttggatctatcacctgcatcataactggcttctgcttgtcatccacacaacaccaggacttaagacaaatgggactgatgtc

SEQ ID NO: 53253 - DNA, 300 bp, Homo sapiens
gttttttttcttttaaatgtaatacctcctcatcttttcttcttacacagtgtctgagaacatttacattatagataagtagtacatggtggataacttctacttttaggaggactactctcttctgacagtcctagactggcttctacactaagacaccatgaaggagtatgtgctcctattattcctgctttggctctgccaaacccttctttagcccttcacacatcgactgaagaatatgatgctgaaggatatggaagacacagatgatgatgatgatgatgatgatgatgatga

SEQ ID NO: 53254 - DNA, 216 bp, Homo sapiens
  misc_feature 150: n = A,T,C or G
tgagcctgccgttcatggtggtctttcaggttatcttggcaacatgtacattgcttttattttttttcttttttgctttcattgtacagtcagtactataaaatttctcttttgagttttatacctttgtagcattttagatgacattgngtttgtactttggtgtgtagagtggaagaattgtgttgaataaacccaagatcggaatgcaaatca

SEQ ID NO: 53255 - DNA, 314 bp, Homo sapiens
  misc_feature 277: n = A,T,C or G
tttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgtatttatcaatttttcccagtattttatacggaaaaaattgnattgaaaacacttagtatgcagttgataagaggaatt

SEQ ID NO: 53256 - DNA, 156 bp, Homo sapiens
  misc_feature 142: n = A,T,C or G
ctttgaatatcgaacacgcaaggctgtgagactacctattgtagatattgcaccctatgacattggtggtcctgatcaagaatttggtgtggacgttggccctgtttgctttttataaaccaaactctatctgaaatccccnaaaaaaaaaaaaaa

SEQ ID NO: 53257 - DNA, 228 bp, Homo sapiens
agaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttggtctttgccagtctcattttcatcttcttccatggttccacagaagctttgtttcttggcaagcagaaaaa

SEQ ID NO: 53258 - DNA, 331 bp, Homo sapiens
gaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagat

SEQ ID NO: 53259 - DNA, 204 bp, Homo sapiens
aatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaaaa

SEQ ID NO: 53260 - DNA, 308 bp, Homo sapiens
ggagctgactctaatcaaatgtgatgattggaattagaccatttggcctctgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatgggttaatcactaccattgtgaaacataactgt

SEQ ID NO: 53261 - DNA, 309 bp, Homo sapiens
attccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggccaacagaaatctgtgataaaaagaaagactaaagaaattttcctaaaggaccccatcatttaaaaaatggacctgataatatgaagcatcttccttgtaattgtctctgacctttttatctgagaccggaattca

SEQ ID NO: 53262 - DNA, 108 bp, Homo sapiens
tgcaaatggattcaacatgtttatgggttattaaaattgtctgatttcttaggttctttatagtacacgtgttgaaaataaatgattaagaattgtttcaagaatgcc

SEQ ID NO: 53263 - DNA, 330 bp, Homo sapiens
atctctgctgagaaagcctaccatgaacagcttactgtagcagagatcaccaatgcttgctttgagccagccaaccagatggtgaaatgtgaccctcgccatggtaaatacatggcttgctgctgttataccgtggtgacgtggttcccaaagatgtcaatgctgcattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccga

SEQ ID NO: 53264 - DNA, 181 bp, Homo sapiens
cgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttggc

SEQ ID NO: 53265 - DNA, 340 bp, Homo sapiens
cgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggtctaagacgtgggatcggttccagatgagaattcacaagcgactcattgacttgcacagtccttctgagattgt

SEQ ID NO: 53266 - DNA, 357 bp, Homo sapiens
tcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaaaaaaaaaa

SEQ ID NO: 53267 - DNA, 366 bp, Homo sapiens
atgtaacacaccttcacatgtacctctgaacctaaaataaaagttaaaaatatatgtatttcttgctattatgttaatggataaattaaacttcataaaggccaagcacagtggcttcgccaggcgtggtggcttaggcttgtaatcccagaactttgggaggcaaggcgggcagatcatttgagctcaggagttcaagaccaacctgggcaacatggcaaaacaccatctctacaaaaatacaaaaatcagccaggcatggtggcacacacctgtggctccctgctactcagaggctgaggtgggaggatcgcttgcacccaggaaacagaggttgcagtgagctgagatcatatcactgcactc

SEQ ID NO: 53268 - DNA, 163 bp, Homo sapiens
ttaggtgaatctgaaacttccatttgcaaataatatatttgtcaataactacattctgctctcctctggcagctttactctcctttcgtttattttgtagcttttgtaaatattttacaaatatttttggctaccagtcagtgtttgtgtgtgtctgtgtgtg

SEQ ID NO: 53269 - DNA, 291 bp, Homo sapiens
  misc_feature 130: n = A,T,C or G
cttgattcccttaatgtagtatttcatatttattgttttgtgtatattggaccatccttgcatcccagggataaatcccacttgatcatgttacatgatctttttaatgtgctattgaatttggttaggnagtatttcactgaggatttttatcatctatgtttattagggcccaaaagacatatatagaacattctacccaacagtggcagaatacacattctttctaagtgcatgcggacattcttcaagatggatcacatgttaggctacaaagcaagtcttaacaaa

SEQ ID NO: 53270 - DNA, 348 bp, Homo sapiens
  misc_feature 271: n = A,T,C or G
acctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaataccacaaagaagattgtgctaaggctggaatgtgttgagcctaactgcagatccaagaggatgctggcattaagagatgcaagcattttgaactgggangagataagaagagaaaggccaagtgatccagttctaaactttgggatattttcttcaattttgaagagaaaatggtg

SEQ ID NO: 53271 - DNA, 127 bp, Homo sapiens
  misc_feature 34, 46, 102: n = A,T,C or G
tgaactgctttgggagattcagtagaaagagtgntatcatattggngctgagtgctatgtgtgcttatacaatttgttcttgtattttaataaactttgaancttaaaaaaaaaaaaaaaaaaaaaa

SEQ ID NO: 53272 - DNA, 119 bp, Homo sapiens
atgcacctctttaccttttttacttggataaaaacctatgatgattttgtcctgtgtgtaaatgttatttatttagcatagacattaaagataactctctggaaaatgaaaaaaaaaaa

SEQ ID NO: 53273 - DNA, 391 bp, Homo sapiens
ggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaaagcccaaattcaggaaatgaaaaagagagaaaaagaagaaatgaagaagaagagggaaatggatgaacttaggagctat

SEQ ID NO: 53274 - DNA, 316 bp, Homo sapiens
agagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgcaacagatcaaagcagcatatctccaggaaacaggaaagcccctggatgaaacactgaagaa

SEQ ID NO: 53275 - DNA, 339 bp, Homo sapiens
ggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggcatttaagtttagtagtaaaagactggtaatgataacaatgcatcgtaaaaccttcagaaggaaaggagaatgttttgtggccactttggttttcttttttgcgtgtggcagttttaagttattagttttaaaatcagtactttttaatggaaacaacttgaccaaaaattgtcacagaatttgagacccattaa

SEQ ID NO: 53276 - DNA, 362 bp, Homo sapiens
atcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagcacagatttcattataaatagcctccctaaggaaaatacactgaatgctatttttactaaccattctatttttatagaaatagctgagagttctaa

SEQ ID NO: 53277 - DNA, 227 bp, Homo sapiens
tgaatacttaatatgtgggaaacccttttgcggggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccg

SEQ ID NO: 53278 - DNA, 162 bp, Homo sapiens
cccgacactagatttctaccatcactaatatttggaagtatttcattactaacaatctcagtacaacatgaaaattgttgcttctcatctaaaatacaattttgtctatcagaataaacacaagtgaaattttcgcctacattaacattatgtctttgcagc

SEQ ID NO: 53279 - DNA, 354 bp, Homo sapiens
ctgagtagctgggaccacaggttcacataaccatgcctggctaatttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatcta

SEQ ID NO: 53280 - DNA, 266 bp, Homo sapiens
gagacccccgacccaaaggaaatagatgcagcactgattggacaactttgggtaagtagtggggtacctgggtaaaggatgggattgggttagaggcccaacttaggggagttagagtctctcctaagacacagtgggttggagcccctcttaataaaaggcaaggacgcttgactgaccttgggttagaggcccaacttaggaggattagagtcccctctcgtcactattggatgttaactgctattctctttggattaatctgc

SEQ ID NO: 53281 - DNA, 362 bp, Homo sapiens
tttaaagaggaggtaggaaaagagaaagggatagtaagtctattcagaggagtaataacagaggacttctcaaacctagagaaagatatcaacatgcaagtacaagaaaattacagaacactaaggagatttaacccaaagaagactccctcaaggcatttaatcaaactaccaaaagtcaaggctaaagaaaagatcctaaacagagcaagagaaaagaaacaacatacaattgagttccaatatgtctgacagcagacttttcagtggaaaccttacaggccaggagagagtggtgtgacatatttaaagtgctgaagaaaatgaacttttactgtggaataatatgtctagtgaaaatg

SEQ ID NO: 53282 - DNA, 100 bp, Homo sapiens
tgagacagggtctggaacagaatctgacagtgatgaatcagtaccagagcttgaagaacaggattccacccaggcaaccacacaacaagcccagctggcg

SEQ ID NO: 53283 - DNA, 343 bp, Homo sapiens
  misc_feature 174: n = A,T,C or G
ctggttctctcctttccagacggagacctctgccgcaaacatgctccgcagatcatcggtcaggccaagaagcatccgagcttgatccccctctttgtatttattggaactggagctactggagcaacactgtatctcttgcgtctggcattgttcaatccagatgtttgttgngacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccg

SEQ ID NO: 53284 - DNA, 119 bp, Homo sapiens
  misc_feature 105: n = A,T,C or G
acttttcagtcttgggaagagaataatcacatgatgctattcatccagtcatttatccatcaaacatttaagaatctacttaaattttcacagtagggaactganaacaaaaaaaaaaa

SEQ ID NO: 53285 - DNA, 204 bp, Homo sapiens
gatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttacc

SEQ ID NO: 53286 - DNA, 267 bp, Homo sapiens
  misc_feature 80: n = A,T,C or G
ttggttactgtagttttgcagtataatttgaagtcaggtgatgcctctggctttgttctttttctttaggattgctttgnctattctgctctatttttggctccattttacattttagaataggtttttctaattctgtgaaaagtaacattgataacttcatagaaatactgttgaatctgtacattgctttgggcagtatggacattttagtgatattagtcattcaaagctatgagcatgaaatgtttttccattggttatgtg

SEQ ID NO: 53287 - DNA, 329 bp, Homo sapiens
tggctgattaacaaaaatatttgagatggcaaaaggtacagaaagggacacttttttttatgaaaacttgcactatgccaaaagcaggggaagaaatatggaatgccacgtcattcattagtctactgtgcatggtaagataagcctgaaaggcttagcaggcagcctgctaagacaagcggcatagcaatgctaatgttctgaaacactcctagcatgtaagtacttaggctgagccaaaaagatggcttcaaaagtaagaatgaaacatttgatccattcagctttaggctatgccactggattcatgtctagaaaagataggataa

SEQ ID NO: 53288 - DNA, 205 bp, Homo sapiens
gagccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtccttaaaaaaaaaaaaaa

SEQ ID NO: 53289 - DNA, 355 bp, Homo sapiens
tttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttaggttaaaagttgtaggtgaataaaataatttga

SEQ ID NO: 53290 - DNA, 353 bp, Homo sapiens
  misc_feature 17: n = A,T,C or G
aaaataaaccatccagnaaaaagctgtgcaaatttttgaacaaatattgcaaaaattcagcaaagaaaaaatacttgtaataataagtacatgaagaagggctcaacatcattagtcaacagggaaatataaattaaaaccacaacgagatatcattgtacacctatcaaaagtggataaattaaagagactaattatactaagtgtcggcaaatatgtggagaaattggacttcttatgcactgctagttggaatgtaaaatgttatgactgcacaataaaaattttatcagtttttaaataagttaaacatatacctgccctatgatctagctgtttactcctagttattt

SEQ ID NO: 53291 - DNA, 316 bp, Homo sapiens
gaactcaatctaaattaaaaaagaaagaaatttgaaaaactttctctttgccatttcttcttcttcttcgtttttaactgaaagctgaatccttccatttcttctgcacatctacttgcttaaattgtggcaaaagagaaaaagaaggattgatcagagcattgtgcaatacagtttcattaactccttcccccgtcccccaaaaatttgaatttttttttcaacactcttacacctgttatggaaaatgccaacctttggaagaaaaccaaaataaaaattgaaaaataaaaaccataaacatttgcaccacttg

SEQ ID NO: 53292 - DNA, 291 bp, Homo sapiens
agagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattggg

SEQ ID NO: 53293 - DNA, 277 bp, Homo sapiens
ttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatgggttattgtagggttttgtttgtttgttttttaaagcaaatgatttccatatccctgattgatcttttttgtcatctttgcttcaaaattacataaaaggtgctcctttcccccttcttttatacaagtttcttg

SEQ ID NO: 53294 - DNA, 192 bp, Homo sapiens
aaggtaaattgcatgtcacggggtttgtagcttattctttcagaaactcttgcattatctgtagacgtggacgtaaatatccacctcatagggttttcataaaaaataattgagataatgtatgtaatgtttcacagtgctttgcagactatctaataaatagtagctatgaaaaaaaaaaaaaaaaaaaaa

SEQ ID NO: 53295 - DNA, 168 bp, Homo sapiens
tttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctaccttaaaaaaaaaaaaaaaaa

SEQ ID NO: 53296 - DNA, 348 bp, Homo sapiens
tgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattatttttatactgtatgtgccaaagctttactactgtggaaagacaactgttttaataaaagat

SEQ ID NO: 53297 - DNA, 299 bp, Homo sapiens
aatactgtaggaacaagcatgatcttgttactgtgatattttaaatatccacagtactcactttttccaaatgatcctagtaattgcctagaaatatctttctcttacctggtatttatcaatttttcccagtatttttatacggaaaaaattgtattgaaaacacttagtatgcagttgataagaggaatttgggataaatatggtgggtgattattttttatactgtatgtgccaaagctttactactgtggaaagacaactgttttaataaaagaattacattccaaaaaaaaaaa

SEQ ID NO: 53298 - DNA, 257 bp, Homo sapiens
  misc_feature 1, 2, 50, 255: n = A,T,C or G
nncgacccggggccatagcccctttgccaacctcaaatcgtgctgtgtgnccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagantt

SEQ ID NO: 53299 - DNA, 397 bp, Homo sapiens
  misc_feature 9, 11, 56, 203, 321, 323, 371: n = A,T,C or G
cgaagaacncncttggattccttgctttcttgacatttccatgactgtttcacatncaaactattgggtgaggtttttcagctgttaccgacccacgtcctgctgtctctgtgtggtcctacaaaaactgtccattcccacccctttgctttgcatttgcaagagtctggaattgtcaaggtctcagcttcgaaaagtcctgntccactggacaggacacattctttagagggaattaagacctacaaagtctagtttgtatgtaggtatgaagggaatttcttaaataaattgaaaagctgtgaacagcattagaacttngnctatttcttaattttaaaatatgctgaatgccttaaactggagtggtngatcctggcatttgctgttggaaaat

SEQ ID NO: 53300 - DNA, 100 bp, Homo sapiens
  misc_feature 16, 19, 28, 29, 34, 40, 42, 55, 64, 67, 70, 71: n = A,T,C or G
ctgtgtgaataactgnaanagagacacnncatgnacgatncnttacaggtgctgnaacaaaatncantannagttctactggaggtggattaaacagaag

SEQ ID NO: 53301 - DNA, 400 bp, Homo sapiens
  misc_feature 4, 15, 44, 50, 273: n = A,T,C or G
cttntattaacatcntattgttgtacgaagtattagacattttnatcccntctccaaaagccgaacgcactaatgacagttttaagtctatgaaaatgctttattttttcattggtgatgaaagtctgaaatgtgcatttgtcatccccactccatcaacccctgaccatgtaaggcttttttattttaaaaaaacagagttatcccaatacattatcctgtgatttaccttacctacaaaagtggctcctgtttgtttgatgatgattggtntatttttgaaacatttattaagggaaaactaagttactgaatgaaggaacctctttcttacaaaacaaaaaaaagggcaggaaatcaccccaaggaacgatttctcaggttgagatgatcaccgtga

SEQ ID NO: 53302 - DNA, 246 bp, Homo sapiens
  misc_feature 2, 16, 51: n = A,T,C or G
antgggaaatgatgtnattttttacaactaattttgtactctcagaatgtntgtcatatgcttcttgcaatgcatattttttaatctcaaacgtttcaataaaaccatttttcagatataaagagaattacttcaaattgagtaattcagaaaaactcaagatttaagttaaaaagtggttggacttgggaacaggactttatacctcttttactgtaacaagtactcattaaaggaaattgaacg

SEQ ID NO: 53303 - DNA, 400 bp, Homo sapiens
  misc_feature 7, 10, 385: n = A,T,C or G
ttgaccngcnggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgctataatcgctacttcaggaagcgccgaggggcaaatgagactgagggaagaaaaaaaatctctttttttctggaggctggcacctgattttgnatccccctgtagcag

SEQ ID NO: 53304 - DNA, 346 bp, Homo sapiens
  misc_feature 1, 11, 53, 57: n = A,T,C or G
ngaaatttccnaaaaataaagatgggttaatcactaccattgtgaaaacatanctgntagacttcccgtttctgaaagaaagagcatcgttccaatgcttgttcactgttcctctgtcatactgtatctggaatgctttgtaatacttgcatgcttcttagaccagaacatgtaggtccccttgtgtctcgatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgca

SEQ ID NO: 53305 - DNA, 100 bp, Homo sapiens
  misc_feature 8, 13, 42, 58, 82, 88, 96: n = A,T,C or G
gtaacctnagacncggactcaaacaatcctcccatctcgccncctcctataaagcacngggattacaggcatgcttgctcantgttcnatggtganacta

SEQ ID NO: 53306 - DNA, 400 bp, Homo sapiens
  misc_feature 3, 4, 163, 341, 352: n = A,T,C or G
ctnngaaccagaggagctatgtgctgctgctgctcaagagctggatccatacaggttgtgtgtcatctgtcctcttgaggttcaggagattctaaattgaatattccacggtttgggacagcatccggaagttttccctatgactttatattttgtattatgncaaatgttatggcaggcccaaatagcatagccacaagtttggtttatgtggcataaaattctaaccaaaccccagacatagggagcatttggagaaagcctgtatgtggtgttttaacctaataaagttgatgagagagaaggggagaggaagcgaacataaagcgggcaagtgtagngcatcttttgnatctcaggcgtgcttcttcagtggccaagctgcaatgcagtattgact

SEQ ID NO: 53307 - DNA, 234 bp, Homo sapiens
  misc_feature 16, 24, 30, 48, 82: n = A,T,C or G
agacgaccaacatggnataatagnagtggnaagactgcctcctttccntgaagagagagattaaggatttttataattgttnttcatcaaattttaatatttttgtcaaatttttaggtatttaatttgtaaaacagtttgctttgtactggcatacagaaaatagggtattgattttaaactttttgaagccaagtgatcaagtacatttgtaataaaagtcaatggatctat

SEQ ID NO: 53308 - DNA, 100 bp, Homo sapiens
  misc_feature 6, 10, 36, 38, 50, 52, 56, 58, 68, 71, 76, 82, 99: n = A,T,C or G
gaagtntacnggggcagagaaccattgcaagacttngnctaaagaaaatntntagngngagcaattgnaanggganacccgncagaacctaaaaatgcna

SEQ ID NO: 53309 - DNA, 399 bp, Homo sapiens
  misc_feature 14, 28, 237: n = A,T,C or G
tacatgcaaaagantaaggaaaaaaccnttaaagtggacaggtatccagagtccattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgngacaattgtcaaaaaatgcactaaaatgtaaatggagattgaacaagttcactttccagcttataggcaactttatacagacttgacattttctccagttgttagtaaaagtgaaagagaaagggttttcctgccacaggatataacttttttttatataac

SEQ ID NO: 53310 - DNA, 246 bp, Homo sapiens
  misc_feature 11, 16, 53: n = A,T,C or G
gacatcaccanacganttgcactcatgagctgtccccacattaggcttaaaancagatgcaattcccggacggctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtacttaccctatagcaccccctctaccccctctagag

SEQ ID NO: 53311 - DNA, 182 bp, Homo sapiens
  misc_feature 6, 16, 33, 169, 180: n = A,T,C or G
gaaccnaaaagaaggnaataactatagcatggnaaggtagagaaaaaaacaacagaaaaaattgctataggaaatagaagtagtttgggtagcatctgctttgaactctccacaataaaaaaaaaaatcaattctatgaaataagagataacaggttcaagcgaaatancatatggggangc

SEQ ID NO: 53312 - DNA, 157 bp, Homo sapiens
  misc_feature 2, 40, 43, 46, 57, 58, 68, 72, 77, 132, 140: n = A,T,C or G
cngggattaccccgttcaaaagtgtatggcccaccctcanagncangcacttttaanntgaagaaaangatnctgcnagcagcttatttaaaacttggggtcctttttaaataagaaaaattatataaattntagaagtnatttcataaagccatac

SEQ ID NO: 53313 - DNA, 155 bp, Homo sapiens
  misc_feature 7, 16, 27, 39, 51, 55, 104: n = A,T,C or G
gaagaancccctaagnaggatgagagntacgtaaccggntacgagtgaagnttanatccaagttcagactcaaaggcattattatgatttgcttcttcccatgncttccatgtcctgcttctcaaagtttttctcatccatcacactcctgcctt

SEQ ID NO: 53314 - DNA, 294 bp, Homo sapiens
  misc_feature 3, 23, 27, 29, 30, 32, 33, 37, 38, 39, 45: n = A,T,C or G
tantgtctaggagcactaccatntgtntnnannatgnnntgccanacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagact

SEQ ID NO: 53315 - DNA, 182 bp, Homo sapiens
  misc_feature 4, 11, 12, 16, 18, 19: n = A,T,C or G
accnagcgccnnggtncnnactgttgaaaaagaaccccaaaataaatgaaaaccattcattaccattcctggccaatcccaagtcattcatgaacctgtaaataatctcgatatggagctgaattgttggagaaacaagagatcttataaatataaaacaatcccagtcagtaatgcctatg

SEQ ID NO: 53316 - DNA, 160 bp, Homo sapiens
ccgagcaggccgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctg

SEQ ID NO: 53317 - DNA, 357 bp, Homo sapiens
  misc_feature 9, 327, 346, 349: n = A,T,C or G
ccgaagggnccctgtgtctgcagaaattttgtttcctgtacttcatagctggataatggggaaagaaatctgcagcaaaggggctcactctgttgccaggctggctcaaacttctggactcaagtgatcctcccgcctcggccttccaaagtgctgggatatcaggcactgagccactgcgcccagccaacaatccgcctgaggaaagcgtaagcaggaagacctcttaatggcatagcaccaataaaaaaatgactcctagttgtggttggaaagggagagaagagatgtctgaggaaggcatgttctttcagcttatggcatttnctagagtttgttgaagcangangaaaaact

SEQ ID NO: 53318 - DNA, 400 bp, Homo sapiens
  misc_feature 3, 13, 45, 47, 62, 77, 90, 92, 151, 161, 162, 318, 336, 354,358, 385, 391: n = A,T,C or G
ccncttacttggntctgtcctaggatgcggaggaaagttcatgantnacgctagcagagagnatgactcggctaccnagcctaggggccncnggacgggaacactccattccaagatctcagcagagcagggcttcctggcttgaggctgnaagcctttgnnaagaggcccagctgggacattccctggcacctgcttccgctgaagggagcaaggtgccctctgggactgacagccatgaccctctgtgccatcctcaatccttgagccatatatcaagagcctctagagccggatggacctcaaaagctgccaagnaatgccaacgttcaccgnctctgagaaacgacgcanatcnctgagctgggaccacttggagaaccgncttagnaacaagcct

SEQ ID NO: 53319 - DNA, 237 bp, Homo sapiens
  misc_feature 2, 12, 86, 226: n = A,T,C or G
tngctgtccaanggcatccagcgagtcgttgaagaggaggtgctctgtagcagaaactgagctccgggtggctggttctcagtggntgtctcatgtctctttttctgtcttaggtggtttcattaaatgcagcacttggttagcagatgtttaattttttttttaacaacattaacttgtggcctctttctacacctggaaatttactcttgaataaataaaaacncgtttgtcttg

SEQ ID NO: 53320 - DNA, 400 bp, Homo sapiens
  misc_feature 14, 18, 35, 37, 47, 57, 79, 239: n = A,T,C or G
ccaatagcaaagcnaccnacacagttctggaggangngtgcacggtnacacacgtgnggaatggagcaaaacagtcttngaatatcgaacacgcaaggcttgtgagactacctattgtagatattgcaccctatgacattggtggtcctgatcaagaatttggtgtggacgttggccctgtttgctttttataaaccaaactctatctgaaatcccaacaaaaaaatttaactccatangtgttcctcttgttctaatcttgtcaaccagtgcaagtgaccgacaaaattccagttatttatttccaaaatgtttggaaacagtataatttggcaaagaaaaatgatacttctctttttttgctgtccaccaaatacaattcaaatgctttttggtttat

SEQ ID NO: 53321 - DNA, 178 bp, Homo sapiens
  misc_feature 4, 31, 32, 37, 68, 128, 171, 172: n = A,T,C or G
gganaaatccaaaaaagtaagtgggaccctnnatagnatcaaaacattgtcccctcgccctgtaacanttagaaagatgacccaaaccccagtccctagacagttgtcctaggcaagattttgttctngggaccttatttaaatttgccaaaggtggtatcaagaactgcnnaaaaaa

SEQ ID NO: 53322 - DNA, 152 bp, Homo sapiens
  misc_feature 7, 13, 32, 37, 39, 47, 51, 64, 66, 70: n = A,T,C or G
gcttagntgaaanacagggcgaaggaagcaantgganangcctttgnctcncatgagcagaggnangacnttcagttctgtctgtcctttgtccacaaggaatttccctgtgggcagaatgtgagggaggtattcagcttaaaaaaaaaaaa

SEQ ID NO: 53323 - DNA, 193 bp, Homo sapiens
  misc_feature 1, 2, 25, 37, 54, 58: n = A,T,C or G
nngacagtccatgctaagaaaaganttggggaaggtnataataaaagtattttntggngaccataagaatgtccctccccaaacaagtaaacttgtgaaagtttaatttggaattagtggaagctgttcctttgaaagccaagatattatttaagttgtaaagccagctaataaaatgccttagtttgagcat

SEQ ID NO: 53324 - DNA, 134 bp, Homo sapiens
  misc_feature 1, 6: n = A,T,C or G
ngcggnaagccccagattaataacgtaagcacccacctcaacaacctatgaatagtaaaagcaaacctaaagtaaacaagaggaaggaaataaataagagcagaagttattgaaattcaaaacaacaaaaaaaa

SEQ ID NO: 53325 - DNA, 397 bp, Homo sapiens
  misc_feature 1, 4, 39, 55, 59, 88: n = A,T,C or G
ngangatgcccgaacttgttgctggagggcagcagcagnttcacttacactgttnttgnagatggctgctctaaaaagacaaatgaanggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtggcaaaagagaaaaagaaggattgatcagagcattgtgcaatacagtttc

SEQ ID NO: 53326 - DNA, 100 bp, Homo sapiens
  misc_feature 5, 13, 46, 53, 57, 63, 82, 95: n = A,T,C or G
ttgtnctttaacntgaaagcctgtttttccttgcaaactcaaatcngagagcntggnccaagnccaggtataacattcctantggaagccatacntatat

SEQ ID NO: 53327 - DNA, 180 bp, Homo sapiens
  misc_feature 3, 5, 6, 7, 16, 18, 46, 47, 48, 57, 140, 166, 167: n = A,T,C or G
tgngnnncaagacttngnttttcttaattgcatttggggggctatnnnaatgttttncttttaaaataaacagctgggaccatcccaaaagacaagccatgcatacaactttggcatgtatctctgcaaagcatcaaatnaaatgcacgcttttggcatgacatannaaaaaaaaaaaaa

SEQ ID NO: 53328 - DNA, 187 bp, Homo sapiens
  misc_feature 2, 21, 36, 114: n = A,T,C or G
tngactgtctcagagcacgcngcgacaatgatggtntaaaattctctttaataaaattcagaaaattcacctgaaacgtattttgacctaaaagaaacatatttttgtatcagnattgaattttggacagtgcccccatataaggaagttactgttttaaaataaagcaaactaactgttttatttt

SEQ ID NO: 53329 - DNA, 400 bp, Homo sapiens
  misc_feature 8, 10, 279: n = A,T,C or G
acaggacncnaatgatgggtgaacttgttgctgagggcaacagcaggttcacttacactgttcttgtagatggctgctctaaaaagacaaatgaatggggaaagacaatcattgaatacaaaacaaataagccatcacgcctgccccttccttgatattgcacctttggacatcggtggtgctgaccaggaattctttgtggacattggcccagtctgtttcaaataaatgaactcaatctaaattaaaaaagaaagaaatttgaaaaaactttctctntgccatttcttcttcttcttttttaactgaaagctgaatccttccatttcttctgcacatctacttgcttaaattggggcaaaagagaaaaagaaggattgatcagagcattgtgcaatac

SEQ ID NO: 53330 - DNA, 397 bp, Homo sapiens
  misc_feature 14, 53, 55, 295: n = A,T,C or G
ggaagagcccgaanaaggcatcaacagactcactgactatatcagcaaagtgntngaataaacataacttacctgagctagggtggcagcagaaattgagttgcagcttgcccttgtccagacctatgttctgcttgctgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtntatgaaatctaatgggaaatggatcacacgatttctttaagggaattaaaaaaaataaaagaattacggcttttacagcaacaatacgattatcttatagga

SEQ ID NO: 53331 - DNA, 398 bp, Homo sapiens
  misc_feature 1, 11, 279, 304, 334: n = A,T,C or G
ncgagaactcnagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtangccatatatgataaattatgtcagngggaacttagttatcagaaatcagctcagnggtcttccccgcatgatcacatttgatgagttttaaaaatcaaagggattttgaaaatctctaa

SEQ ID NO: 53332 - DNA, 302 bp, Homo sapiens
  misc_feature 3, 4, 27, 33, 44, 45, 49, 50, 60, 90: n = A,T,C or G
aanntagcacttaacttgcgtggagcntcaatntgactgggacnnactnnggcgcaaatnatattacacatgtaagttgtatggcagttnacagaactcaatgacttgtcatgaggttttcatatgagctacacactgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcctc

SEQ ID NO: 53333 - DNA, 251 bp, Homo sapiens
  misc_feature 8, 13, 29, 35, 37, 44, 45, 55, 78, 101, 116, 132, 199: n = A,T,C or G
ccgaagcngttcnttcccccaacttatgntattgngncctttgnnaaaaatcagntggctgcaaatacatagatttanttctgggttttctgctttgcatnatatctgtacatttncagaagttcctcttgntactgatttctagattatgctattgtggcacgaaaagatacttgatataatttcaattcttttgtanttggagacctctttgtggcctaatatgtggctatcctggaaaatgttgcatg

SEQ ID NO: 53334 - DNA, 142 bp, Homo sapiens
  misc_feature 8, 9, 38, 43, 44, 47, 130: n = A,T,C or G
gagtagcnnaagtctgcttatgagatgctcggtaacantttcnncantctgacaaaggtcgacaagactgtacagtcaagatcttggctgcttggggggaagcggaaagatttgctaatattgagaatcngttgtatcaaac

SEQ ID NO: 53335 - DNA, 397 bp, Homo sapiens
  misc_feature 86, 87, 287: n = A,T,C or G
cgaaggagcccggagtggtcggtgggtgggatggaggcgaccttggagcagcacttggaagacacaatgaagaatccctccattgnnggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagngcacaaaatggcctcttgatgctcatatctgtcttcagcagcctgcataggactggatcctacctatgttaattaccttatagaactactaaagtccagtagtagccatt

SEQ ID NO: 53336 - DNA, 337 bp, Homo sapiens
  misc_feature 10, 21, 32, 35, 36, 40, 54, 55, 59, 64, 68, 71, 80, 321, 328: n = A,T,C or G
acccacgcantttgcgaaganctcacgaaacntgnngagnctgctattccccgnnggcnagagnggcnaanagaagacgntcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgngtataangaccttaac

SEQ ID NO: 53337 - DNA, 398 bp, Homo sapiens
  misc_feature 4, 377, 395: n = A,T,C or G
ccgnggtcccccgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaacttgacctgcttaatacattctaggcagagaacccaggatgggacactaaaaaaatgtgntaatttcattatctgctngga

SEQ ID NO: 53338 - DNA, 106 bp, Homo sapiens
  misc_feature 8, 11, 14, 17, 19, 22, 23, 41, 43, 46, 50, 53, 62, 64, 76,80, 89: n = A,T,C or G
aactcctntgnggnggnanaanngaggaccaatgacgaccngnacngagngangcccgggangntgttataagcgnatgntaacagatnaggtgaacttaccgaag

SEQ ID NO: 53339 - DNA, 161 bp, Homo sapiens
  misc_feature 3, 72: n = A,T,C or G
atnctgttaaggtgaacaataaaaaccaaaatatggggctgcttttgtcacactagcatagagaatgtgttngaaatttaactttgtaagcttgtatgtggttgttgatctttttttttccttacagacacccataataaaatatcatattaaaaaaaaaa

SEQ ID NO: 53340 - DNA, 397 bp, Homo sapiens
  misc_feature 1, 6, 26, 55, 79, 86, 109: n = A,T,C or G
ngaagnatcccaggatggtaacaatnttggagtggctgtccaggtgagagcgctncccacttccctgctcttttctagnccatgcntccttccactttcccccttgctntttttccctaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagg

SEQ ID NO: 53341 - DNA, 400 bp, Homo sapiens
  misc_feature 8, 20, 28, 31, 45, 49, 63, 73, 124, 381: n = A,T,C or G
atgactangtctacttctcnatgctcangcnaggttaggaaaggncggngggcgagccaccanattacctagnctgaggttagagagattggccagcaaaaaactgtgggaagatgaactttgncattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgtctagtactgtattgggcttcttcgttaatagattatttcatatactataattgnaaatattttgatacaaatg

SEQ ID NO: 53342 - DNA, 148 bp, Homo sapiens
  misc_feature 10, 11, 43, 50, 58, 76, 98: n = A,T,C or G
gaagcctgtnnaaaacatggcacagtgagggaatatacccccntccccangaacactntatacatattaaatgganatatgattactgtgcaaaaatncattctggaaatgaacatatatttgagcactaatatgtaatgtacacctg

SEQ ID NO: 53343 - DNA, 400 bp, Homo sapiens
  misc_feature 8, 14, 57, 107: n = A,T,C or G
gattaccncaaagnaatagaacggtagacctacccaagtgtcaaccatatcggtagntacgttacatgtaaatgggctaacatagggattaaaagagattgccagancggattaaaaaagcatggcctaactatatgctttctacacaaaacccattttaaatgtaacaatatagataggttaaaggtaaaaggatgaagaaagatataccatgcaaatactaatgaaaagaaaactggggtgtctagattaacatcagacaaagtagatgtcagaacaatgaaaattaccagggataaaaaaacgacattgcataatgatatagggataaagtcatccaaaaggcataataattattaatgtgtatgcacctaaatacagagcttcaaagtgtgtgaag

SEQ ID NO: 53344 - DNA, 128 bp, Homo sapiens
  misc_feature 4, 12, 57: n = A,T,C or G
ccgngaataccncatggggagaaccccaaccaaagaaatctgaaatatataagtaantgctttttttccgtttttgttcattttggatgctggtgctaaacctccaagtgtcatgatttaaaaaaaaa

SEQ ID NO: 53345 - DNA, 106 bp, Homo sapiens
  misc_feature 17, 18, 31, 39, 44, 63, 86, 90, 92, 99, 102: n = A,T,C or G
ccgaagaaccccactgnnaaatttgaaaaantaattgtngctcngaagaaaccctctcggctntatgatgcttatgaactgaaacntgcntngaagggngcnggaa

SEQ ID NO: 53346 - DNA, 269 bp, Homo sapiens
  misc_feature 46, 47, 74, 75, 183, 206, 248, 268: n = A,T,C or G
gttaagaaaggcaaaccagagctcagaaaaaaggtacatccatttnnggcattcgacaacgaaagtcataccgnnggaaaagatggcgtgtttctttattttgaagataatgcaggagtcatagtgaacaataaaggcgagatgaaaggttctgccattacaggaccagtagcaaaggagtgngcagacttgtggccccggattgnatccaatgctggcagcattgcatgattctccagtatatttgnaaaaaataaaaaaaaactana

SEQ ID NO: 53347 - DNA, 326 bp, Homo sapiens
  misc_feature 6, 23, 28, 30, 32, 45, 52, 57, 66: n = A,T,C or G
aaagcntttggtaaatcatcgcngagtntntntctgatgccaacngcaaacngctcntccattaanggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttaccg

SEQ ID NO: 53348 - DNA, 134 bp, Homo sapiens
  misc_feature 15, 129: n = A,T,C or G
acccaaataaagtanaggcgatagaaattgaaacctggcgcaatagatatagtaccgcaagggaaagatgaaaaattataaccaagcataatatagcaaggactagcccctataccttctgcaaaaaanaaaaa

SEQ ID NO: 53349 - DNA, 286 bp, Homo sapiens
  misc_feature 9, 12, 33, 39, 41, 45, 47, 54, 60, 91, 100, 101, 111, 114,115, 122, 133, 134: n = A,T,C or G
tggcggtgnccntgcgcaactggtatgcttganatggcnancgcntnaacgccntagggntgtacactgaaaattcggtaaaaataagttntatatgtanntaatcacaanttnncaaattnaaagaaacggnnagaataggactaggaatataaaagaaatgtatatgagagactattaagtacaaaggcgtagaaaacaaactgttaatgtattttagctctaaaagtatgtatgtaaggcctgaaaatgatatgaaaaataaaaattgtattagtatactagg

SEQ ID NO: 53350 - DNA, 200 bp, Homo sapiens
  misc_feature 1, 36, 43, 57, 89, 90, 91: n = A,T,C or G
ncgacggcgccccagatatagcacccgcaagggcanagacganaaattataaccaancataatatagcaaggactaacccctatacctnnngcataatgaattaactagaaataactttgcaaggagagccaaagctaagacccccgaaaccagacgagctacctaagaacagctaaaagagcacacccgtctatgtagc

SEQ ID NO: 53351 - DNA, 400 bp, Homo sapiens
  misc_feature 5, 13: n = A,T,C or G
caggncccagcgncgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcgggg

SEQ ID NO: 53352 - DNA, 359 bp, Homo sapiens
  misc_feature 2, 50: n = A,T,C or G
gngcccatcagatcttaatactcacttccaactcttgtggagataggccntgtgaaaatcaaagaccatcaagaagagaaagtttcttttactatgaaagtcataaatgtgacttcacccaacatttagtgacttagagtggactgaggctccattattagtaatgtggagagatttcattaaatgtttataccttacatgagaaataaaaattcacagtgtggagaacacttctgctgtaaggcacgtgggaaagcttttactaattccacgaggctcattttacatatctaaaattagactgcaagtgagccaagacccctacactccatcctgggtgacaaagcaagactctgtct

SEQ ID NO: 53353 - DNA, 137 bp, Homo sapiens
  misc_feature 8, 12, 25, 30, 45, 56, 82, 86, 88, 95, 107, 114: n = A,T,C or G
cgaagaanccgncagaatatgttanagggncgaagcacacatacnagcagttgtantgaaaagaacgattcgttatgtgacntacngncggttcncagcaaagagcnctacacnagatttctaccatcactaatatt

SEQ ID NO: 53354 - DNA, 400 bp, Homo sapiens
  misc_feature 5, 23, 37, 60, 64, 67, 72, 73, 76, 387: n = A,T,C or G
aagcntcgggacattgcaatggntactagttatcctntaagaaacaactacaaaaagaanatgncancaaannttnccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagcgcatgatttaaaaaaaaaaaaatttatgccctcttatttatttctaggatgaggggaggataacattttngcttcttatggac

SEQ ID NO: 53355 - DNA, 172 bp, Homo sapiens
  misc_feature 20, 32, 44, 52, 53, 58, 61, 66, 67, 87, 88, 107, 128, 163: n = A,T,C or G
ggacaacaccactagaacancctacgcagganagctgattaacngaatcccnntttcnccnatggnngctggcggaaataaactgcnnctccccattggtaaacagnaataaaattttaaaaatgaanaaaaaaaacaaaaaaaaaaaaaaagaaaaaaaacnaaaaaaaaa

SEQ ID NO: 53356 - DNA, 182 bp, Homo sapiens
  misc_feature 15, 21, 29, 34, 35, 44, 49, 59: n = A,T,C or G
gagatagcactgcancgctcnagcttttnttatnncagaaaccnggagnacccgagatntttattaaattatgtaagaagatagcacagatatcgggatattattgtgtgaaaatgctgcttttactttgatgtgatctcattgatgtacacaaccaagttccaataaagtgctagaatgtg

SEQ ID NO: 53357 - DNA, 398 bp, Homo sapiens
  misc_feature 1: n = A,T,C or G
ncgatcttgcccataattttgcaaaaacaaaattattttgacacaaactggtcattgaacatactctgatacaaagaaaaatgacacttaaaacatgacttcagaattctaagtaaaaaaattaaaactcttaaaacaagcagaagtctcttttgctcactggggacagaaataggtattctataaagcttagtttttagactggacatggtggctcatgcttgtaaccccagcactttgggaagccaaggtgggtggatcacttgagcccaggcatttgagaccagccagggcaacgtggctaatttccgtctctactagaaatccaaaaaaattagctggcatgttgcgtgcacctgtagtcccagctactctaggggctgagatggggaggattg

SEQ ID NO: 53358 - DNA, 398 bp, Homo sapiens
  misc_feature 1, 55, 56: n = A,T,C or G
ncgaaggcgccgacagtggcctcgagaccctgcctgcctgaggaggcctcggttnnatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtt

SEQ ID NO: 53359 - DNA, 398 bp, Homo sapiens
  misc_feature 4, 15, 57, 105, 153, 161, 176, 284, 307, 343, 356, 364: n = A,T,C or G
ccgnagcagcccgcngtagaaaaatttcactttttaaaagaattataaaaccatagntttataaatcagtggaaagtggcttacagagagaactatcagatgtgnttacatcacatcttattcacttttttaacagctctaatgctttggcantgctatgntcatatttatgtatnccttatttatagctctgatagctttaattttctaagcagctgtctatcagatgcgcacatctgctgtgccaggttgaagtatagtggaacccatcagtagtaatgcgnagcagtatgacttgttgacattnccattataaactttaattttgaattgtttatgcatnataactggggatntatattgnatcgggctgaaagttgacaggatttcagccccac

SEQ ID NO: 53360 - DNA, 398 bp, Homo sapiens
  misc_feature 1, 48, 59, 61, 69, 72, 82: n = A,T,C or G
ncgaaggtacccgctgttgttttcagcctgctgcttgctgcttgctgnatgccggctantnggaaccgncgnggggaagganggggtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctggctagatgtattgatgg

SEQ ID NO: 53361 - DNA, 100 bp, Homo sapiens
  misc_feature 11, 23, 31, 44, 47, 53, 54, 55, 56, 67, 76, 78, 80, 88, 89: n = A,T,C or G
tacattgtcgnagatttccattntttaggtnacgtacgaaagancgnacctannnntgctagcagtntaagacagncntnggcagaannacgcctgcggc

SEQ ID NO: 53362 - DNA, 398 bp, Homo sapiens
  misc_feature 42: n = A,T,C or G
gctgatcgcagagctgcggaagatgaatgccagaggacttgnatctgagctaaaggacagtattccagttactgaactttcagcaagtggaccttttgaaagcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcaggtgcagcaggttcagcgtcttccatttctttcaagctcaaatctttcactggatgttttgaggggtaatgatgagactattggatttgaggatattcttaatgatccatcacaaagcgaag

SEQ ID NO: 53363 - DNA, 100 bp, Homo sapiens
  misc_feature 11, 14, 41, 46, 67, 84, 85, 98: n = A,T,C or G
aacaaaatcgnagnagttgatgcagctagctcttgaggctnctgantaattcggctaaggatgggantgagcattcaacagcanntctgctgttgacnat

SEQ ID NO: 53364 - DNA, 398 bp, Homo sapiens
  misc_feature 1, 22, 27, 57: n = A,T,C or G
ncgaaggctcccagaagatgtnaatgntactttcgaagatcaacaaaagataaactnatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttata

SEQ ID NO: 53365 - DNA, 400 bp, Homo sapiens
  misc_feature 2, 7, 37, 57, 58: n = A,T,C or G
gncgaancctctcgtaagagcgcttcggaatccattngccatgcggaccttacagcnngctcggcagactccagcagccaagatggtggaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtcta

SEQ ID NO: 53366 - DNA, 400 bp, Homo sapiens
  misc_feature 7, 16, 29, 36, 37, 46, 61, 62, 86: n = A,T,C or G
gcgaatncttctgcgngaacaaatattgngttaaannagacggctnaaagagcagggaagnnaattttggttatattgagcatggngagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggccactaccagagacagatgaaaaatcacaggaagaa

SEQ ID NO: 53367 - DNA, 300 bp, Homo sapiens
  misc_feature 7, 8, 31, 36, 41, 42, 47, 54, 58, 72, 75, 76, 77, 82: n = A,T,C or G
ggacaannccgcacaaaaagcggagagttgnaggtntcgcnngaacntgactgngttngactgtgccggagnggnnncaggncatggaggcagaatccttggccctcttgtgtggggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtg

SEQ ID NO: 53368 - DNA, 124 bp, Homo sapiens
  misc_feature 18, 51, 56, 57, 80, 88: n = A,T,C or G
cgaagggacccacagggngtgatgtctttcaagagggaaggagacgattgnagttnnctcaatgtgctcaaagtaagcgngagcaggngaggatctggagccggttcagtcgctccctgaagaa

SEQ ID NO: 53369 - DNA, 268 bp, Homo sapiens
  misc_feature 2, 3: n = A,T,C or G
anngaaatgtggacttaatgactgaaattgcaaattgtcctttttcttggcattacagattttgccaaaataactttttgtatcaaatattgatgtgtgaaagtgaaggagctagtccgctgaaccaggaatagtttgagatattgaactgtcatttttgcacatttgaatactttgcaggctggctttgtataaacttatcctctggtttcctatatgttgtaaatatttagaccataatttcattataaataaatctataaatatt

SEQ ID NO: 53370 - DNA, 106 bp, Homo sapiens
  misc_feature 1, 2, 55, 56, 77, 84, 87: n = A,T,C or G
nngagagggccagtttggtagcaaccaaaagaaactgaacttcaaatagaaattnnaggtggtctttttttttcctngggtgtncancttgaagcttagaataaag

SEQ ID NO: 53371 - DNA, 384 bp, Homo sapiens
  misc_feature 6, 93, 116, 340: n = A,T,C or G
atatcnaaaataggatgttttactttattgtttcttgctagcccttcactcaatatgctggcattataaagcaaagatagtggagaagaaatnaccaagaactgaagttgtactgntttcttgtatacatctccaccaaggtagtttcttgtagataccatgtgtatgttttgtttctaaaaactgtaggctcctagctttgctattcattgtgttatactttatcctacaaaacataatagcaaattatcagccacaaaacaaaaggatataaaaaatttccctctctgacagaggatgaggaagcaaaagaaaaataaataagtaggccaggcgcggngctcacgcctgtaatcccagcactttgggaggctgaggccggtg

SEQ ID NO: 53372 - DNA, 113 bp, Homo sapiens
  misc_feature 9, 12, 13, 22, 39, 54, 66, 70, 71, 92, 103, 108, 111: n = A,T,C or G
ctagcatgntcnncgtcgaacntggcgaacgctagcaanccaagaggggaacgnagggcgcccggnacannagatgcacggcgagcagacantcgtgcctgcnccggnatngg

SEQ ID NO: 53373 - DNA, 100 bp, Homo sapiens
  misc_feature 4, 5, 30, 31, 58, 65, 78, 95, 96, 98, 99: n = A,T,C or G
agcnngtatgaagaggctcgtccgagagcnncatcggaaagctgcgagagaggcaccntgactcncttatgtttgganctccgtaaacacagttnngnnc

SEQ ID NO: 53374 - DNA, 126 bp, Homo sapiens
  misc_feature 3, 5, 10, 15, 18, 36, 58: n = A,T,C or G
ttnancagtnaaagnganctactatactcaattganccaataacttgaccaacggaanaagttaccctagggataacagcgcaatcctattctagagtccatatcaacaatagggtttacgacctc

SEQ ID NO: 53375 - DNA, 330 bp, Homo sapiens
  misc_feature 8, 11, 31, 59, 82, 119, 157, 167: n = A,T,C or G
ccttatcnttngtaaagcgtagatttaagangcacacagttgtgccgccggtgtggctntaaggcctaccaccttcagaagncgacctgtggcaaatgtggctaccctgccaagcgcangagaaagtataactggagtgccaaggctaaaagacganataccaccgnaactggtcgaatgaggcacctaaaaattgtataccgcagattcaggcatggattccgtgaaggaacaacacctaaacccaagagggcagctgttgcatgcatccagttcatcttaagaatgtcaacgattagtcatgcaataaatgttctggttttaaaaaat

SEQ ID NO: 53376 - DNA, 133 bp, Homo sapiens
  misc_feature 24, 32: n = A,T,C or G
cacaagtcagaaacctgtctaccngaaaaagnaatagctatataaataaaacctgagcagaccaattgtgataccatttcataaacgaaggagtatgattcattttaatctctgcacttgctctacacagcca

SEQ ID NO: 53377 - DNA, 250 bp, Homo sapiens
  misc_feature 174, 178, 188: n = A,T,C or G
cttttggaggccgaggtgggtggatcacaaggtcaggagattgagaccatcctggctaatacggtgaaaccccgtctctactaaaaatacaaaaaattagccgggcggggtggtgggtgcctgtagtcgcagctacttgggaggctgaggcaggagaatggcgtgaacccgggnggcncgagcttgcngtgagccaagattgcgccactgtactccagcctgggcgacaggagcgagactccatctccag

SEQ ID NO: 53378 - DNA, 145 bp, Homo sapiens
  misc_feature 4, 24: n = A,T,C or G
gccnttacaagaccattctcaggntagtgttgctaaaataaaattaaaaaaaaattacaagaccagttgcacacaatgacacgatggtcctggaaaatggggcagccagggaagagaacaggaaaattatatttcccaaaaaaaa

SEQ ID NO: 53379 - DNA, 260 bp, Homo sapiens
  misc_feature 21, 22, 237: n = A,T,C or G
catggaatagctgtaatatannacacctttaattaaaagaaggctcgatgagtgtggagaggtgagggagacatggaagtatttagcaaatgatatagaataagtttgcacctcaattactgtgaaacccaaagagcttttgtatatgtacattttagatattatttactacattaaaaattaaaattgaggtatttaaaatatttatttttaaaacccattacatattggcctaantaaaacttttataaaaccaattt

SEQ ID NO: 53380 - DNA, 230 bp, Homo sapiens
  misc_feature 36, 41, 180, 195: n = A,T,C or G
gcaacataaatgtcttaaaatctgtacatgtctccnatcanaggattcattggcatgccacaggggattctcctccttcatcctgtaaaggtcaacaataaaaaccaaattatggggctgcttttgtcacactagcatagagaatgtgttgaaatttaactttgtaagcttgtatgtggntgttgatcggggggngttccttacagacacccataataaaatatcatatt

SEQ ID NO: 53381 - DNA, 243 bp, Homo sapiens
  misc_feature 148, 149, 150, 232: n = A,T,C or G
atgtcttccacaagagtagacctttctccggacctggttgctactggttcagcaactctgcagaaaatgtcctcccctgtggctgcctcagctcatgcctttggccctgaagtcccagcattgatggcagcccctcatcttccaaggnnngtgctcccctttacctaacgcttcctgcctcccatgcatctgtactcctcctgtgccacaaacacattacattattaaatgnttctcaaacat

SEQ ID NO: 53382 - DNA, 171 bp, Homo sapiens
  misc_feature 24, 66, 111: n = A,T,C or G
aagatgacagagacgcaaggaganaaatccactgccttccaaagaaacgattgaacaggagaagcnagcaggcgaatcgtaatgaggcgtgcgccgccaatatgcactgtncattccacaagcattgccttcttattttacttcttttagctgtttaactttgtaagatgc

SEQ ID NO: 53383 - DNA, 312 bp, Homo sapiens
  misc_feature 35, 238, 259: n = A,T,C or G
cagaaccccactttgcatcaagctgaacgcatatncagccacttgtaattaaggctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggnaaaaagaggcctaacccctgnctttagatttacagtccaatgcttcactcagccattttacctcacccccacaa

SEQ ID NO: 53384 - DNA, 300 bp, Homo sapiens
  misc_feature 21, 174, 175, 176, 262, 280, 293: n = A,T,C or G
catctttcactcaggatgaangcgaaaagtgactgttcacagacctcagttgatgtgagcactgttgctcaggagtgacaagttgctaatatgcagaagggatgggtgatacttcttgcttctcatgatgcatgtttctgtatgttaatgacttgttgggtagctattaagggnnngggagttgataaatgtgtacagggtccttttgcaataaaactgggtatgacttgatccaagtgtttaacaattggggctgttaagnctgaccatacatcactgngataggaatgtgnggctttt

SEQ ID NO: 53385 - DNA, 360 bp, Homo sapiens
  misc_feature 41, 51, 53, 55, 218, 231, 341: n = A,T,C or G
tttgctgcgtctactgcgagtatttaagcactattctcagncaatcagacngngngacattccagaaaatgtcgacattactgctgaagggacgcacagttatcgtgaagggccccagaggaaccctgcggagggacttcaatcacatcaatgtagaactcagccttcttggaaagaaaaaaaagaggctccgggttgacaaatggggggggtaacangaaaggaactggntaccgttcggactatttgtagtcatgtacagaacatgatcaagggtgtacactgggcttccgttacaagatgaggtctgtgtatgctcaccttccccatcaacgttgttntccaggagaatgggtctct

SEQ ID NO: 53386 - DNA, 390 bp, Homo sapiens
  misc_feature 27, 174, 175, 345, 347, 372: n = A,T,C or G
ctaagtggtgagtattcatttgtgccncctcaccccagatgcccatccagaggctgagctgtttatcatgctcatctctttcccaaagcctgaacaaggagcttgggaccactataaacatgttccctttcaataagagaggaaattattatcatatattttggtaataaccannagcatttcaaattacttacatttatggcttataatcaagcttatgcttaacctctaatcctcatgaagctggtgatgatgggctcggtagttaaccacttgcgggaagttaagggcaggtagaaatccacctgaccagtaattaaccaggagaagcaacccatttctgcngntgagattataaacactgtgcttggnttatgtttaattggcaac

SEQ ID NO: 53387 - DNA, 320 bp, Homo sapiens
  misc_feature 21, 175, 246, 267, 298, 310: n = A,T,C or G
aggatgtctcgctcccgtggngcttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagncgacttactgaagaatggagagagaattgaaaaagtggagcattcagacttgtctttcagcaaggactggnctttctatctcttgtactacnctgaattcacccccactgaaaaagatgagtntgcctgccgtgngaaccattgt

SEQ ID NO: 53388 - DNA, 300 bp, Homo sapiens
gaccttttactgcctgcatggaaatcagccaagttttataatccttaaatcttaatgttcctcaaagcttggattaaatacatatggatgttactctcttgcaccaaattatcttgatacattcaaatttgtctggttaaaaaaataggtggggagatattgaggccaagaatattgcaaaatacatgaagcttcatgcacttaaagaagtatttttagaataagaattttgcatacttacctagtgaaacttttctagaattattttttcacctctaagtcatgtatgtttctctttgg

SEQ ID NO: 53389 - DNA, 300 bp, Homo sapiens
  misc_feature 18, 185, 291, 299: n = A,T,C or G
agctagtatagaaaaagnggcctcttcccaaagtggaagccaaattcatcaattatgcgaagaattgcttccggatgactgaccaagaggctattcaagatctctggcagtggaggaagtctctttaagaaaatagtttaaacaatttgttaaaaaaattttccgtcttattggccctttctgtnacagctgatatctggctgtcctttttataatgcagagtgagaactttccctaccgtgtttgataaatgttgtccaggttctattgccaagaatgtgttgtccaaantgcctgtnt

SEQ ID NO: 53390 - DNA, 380 bp, Homo sapiens
  misc_feature 147, 270, 311, 333, 349: n = A,T,C or G
gaattggtcttaagaacattaccagctccaggtttaaattgttcagtttcatgcagttccaatagctgatcattgttgagatgaggacaaaatcctttgtcctcactagtttgctttacatttttgaaaagtattatttttgtccangggcttatcaactaaaccttgtgttaggtaagaatggaatttattaagtgaatcagtgtgacccttcttgtcataagattatcttaaagctggagggagcaaggttgagataatctggggggngaaattttctagttttcattctgtacatttttagttagacntcaggatttgaaatattaatgnttacctttcaatgggnggatcagctggactcagtaacaccccctttc

SEQ ID NO: 53391 - DNA, 240 bp, Homo sapiens
  misc_feature 20, 172, 212, 220: n = A,T,C or G
agagttgcagtgagctgatnttgcgctactgcattccagcccgggcgccgagatagcgccattgcactccagcctgggcgactgaataaaactctgtctcaaaaaaaaaacaaaaacggtaagcttttatatttaattaactgatacctttcactgtgcaatctcaagaggnagattttctaaattagacattggctttaccttaaaagaanaaaattgnctatttcagggtctttttta

SEQ ID NO: 53392 - DNA, 420 bp, Homo sapiens
  misc_feature 10, 48, 89, 200: n = A,T,C or G
aaaaattatnactgttaaagccattgactcctttagtacactgagaanaatcttatagtaaaactagcctttcacattaaggttttggngtgtattttgttaaataactaacatgctgctctattttctgggtgtagaaagtatttggctctaggaaacatttacttgtttgtgaaaacaataccccaaggtaatagganaagtttgaattaagtgtttttaattcagtcagtgaattcagaataagtacattcatgtataacatagggacagttctgctgctggtatttatatgcaattcttctggtaaatagcaatagaataaaacatatttcaatggttggggataggggtttatattattattccactaggaatggcataagaatttatagataaattcttggaacattaaaggat

SEQ ID NO: 53393 - DNA, 258 bp, Homo sapiens
  misc_feature 171: n = A,T,C or G
ttctgatgtcattggcctacctcaggccacgttcttacacctggagtgaaatccagtcatgctgcctggctgccagccttccgtgttagtgctggcctctctctctgtcattctctgcctgctcttctgctcactgtgctcaagtagttcatgggaaggttgcagagtgtnggggatggtttcaagatgcagtgtttggtctcccaattaaaagaattactattacaaaaaaaaaaaaaaaaaaaaaaaaaaaaaaaa

SEQ ID NO: 53394 - DNA, 400 bp, Homo sapiens
  misc_feature 24, 51, 90, 203: n = A,T,C or G
taaatttctagcacaagcaaagtntttaaaatgtcagtaacttaaatgaanaaggttaagaacggctctttgagctgagtatcgcatgcnatgtctaaacaacagtttaacttcactacttatgtcatctgaagatggaaaaactcaattagaatgttatccagctggtaagagcaggcttatgttatatttcagtatttggncatgtgtatttataaatcattactgtggatgtaagaggtatttttttagaatggttgaaatttaaatatgaaaaactcctggataccttgcaaattgaagaaataaaatgatactggttgcagtggcttgagcctatagttgtctcagctacttgagaggctgagtaagtaattactgagtaattactctaagtaat

SEQ ID NO: 53395 - DNA, 190 bp, Homo sapiens
  misc_feature 42, 49, 50, 138, 144: n = A,T,C or G
gtcatcatttcagcattatccaggcatcaaggcaacatctgnctagtgnngggcttcatcaagaacagactatatactaattcccactagaagctgtccatgccatacagaagatctattaaaaagggggtaaatggnaaatgnactctagaccacaggactaatgtaaattaatatacaggcattcatt

SEQ ID NO: 53396 - DNA, 289 bp, Homo sapiens
  misc_feature 28, 42, 151, 248: n = A,T,C or G
gtccaagggcgctgatccgctccttcanctccaccgcccggnaaccgctttcaggaaccgagtgcgcgagaaacagaagctcttccaggaggacaatgacatcccgttgacctgaagggcggcatcgttgacaacattcctgtaccgaggngacaatgacgctgtgtctgggcggcactgtctacagcttgtactcccttggctgggcctccttccccaggaattaagaccaagaagcctgggggggncctgagagacttgaacaagtgtcaaataaacgctggcctcc

SEQ ID NO: 53397 - DNA, 390 bp, Homo sapiens
  misc_feature 137, 139: n = A,T,C or G
ggcacccgatatatgttctctaggccttttagaaaacatggagttgttcctttggccacatatatgcgaatctataagaaaggtgatattgtagacatcaagggaatgggtactgttcaaaaaggaatgccccacangngttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaggagaaaggtacctgggttcaactaaagcgccagcctgctccacccagagaagcacac

SEQ ID NO: 53398 - DNA, 360 bp, Homo sapiens
  misc_feature 7, 144, 145, 148, 221: n = A,T,C or G
cacagtnatgttgaggtgggctccctaggtatggtaaaaagccaggtataatgtaacttcaccccagcctttgtactaagctcttgatagtggatatactcttttaagtttagccccaatatagggtaatggaaatttcctgcnntgnggggtccccatttttactattaaggaagaccagtgataatttaataatgccaccaactctggcttagttaagngagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaat

SEQ ID NO: 53399 - DNA, 320 bp, Homo sapiens
gcatgtggtgtttggcaaagtttaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaac

SEQ ID NO: 53400 - DNA, 115 bp, Homo sapiens
  misc_feature 6: n = A,T,C or G
gggctnaccacactgctctcaggcctcaaaccctttcatacctttattcttttttttaaccaaaaaagtttttcttataaaataaattttgggcaaacatcaaaaaaaaaaaaaa

SEQ ID NO: 53401 - DNA, 118 bp, Homo sapiens
  misc_feature 5: n = A,T,C or G
gaaanagtgggttttttagttgaatttttttaacattcctcatgaatgtaaatttgtactatttaactgactattcttgatgtaaaatcttgtcatgtgtataaaaataaaaaagatc

SEQ ID NO: 53402 - DNA, 320 bp, Homo sapiens
tacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcgtctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgt

SEQ ID NO: 53403 - DNA, 120 bp, Homo sapiens
  misc_feature 51: n = A,T,C or G
caatgaatactgttttcaaggctgaaatagttcattatgttaataaccttntttatgttctcagggaaatgcttaggtggtgtcacaaaatgtgccttttcttttctttttttttttttt

SEQ ID NO: 53404 - DNA, 290 bp, Homo sapiens
  misc_feature 19: n = A,T,C or G
tttattctcatgtacctangttgtggagaaaataattgcatcgctataaactgcctgcagaacgttagcaggctcttcaaaataactccatggtgcacagggagcacctgcatccaagagcatgcttacattttactgttctgcatattacaaaaaataacttgcaaccttcataacttctttgacaaagtaaattacttttttgattgcagtttatatgaaaatgtactgatttttttttaataaactgcatcgagatccaaccgactgaattgttaaaaaaaaaaaaa

SEQ ID NO: 53405 - DNA, 440 bp, Homo sapiens
  misc_feature 347, 398, 416: n = A,T,C or G
taacatttttggggaagctggcttcctattcatggtattttaagagatcatttgtatattatttatcacactgttgtaatgatgttttgagatacttttataacaaaattaacatcagaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagcttttgcgggaggagnttaataggtacacatttcatgctaatatacattttcctttaaacatccacnaattccttaaaaagattngaatcagtaaatttcattttcagc

SEQ ID NO: 53406 - DNA, 300 bp, Homo sapiens
  misc_feature 53, 168: n = A,T,C or G
ttaaaagtacttgtgaagtaaatttctttcttgtgcattttcaatacttgggnactggaaatcagaaaatatttactatgaacaggaaaatctgacatatagccctttttgatatgtttattaataatgattcttaatggggctcataataagtttaatatgcacagnatcttagaaaagtttaacctgcaaacacttttaaaacataatgcctacttgatttatatctataaaaagactgacaggtaattatatttggaaaacatttaatgcactaactttaaagaaattgaaaattca

SEQ ID NO: 53407 - DNA, 330 bp, Homo sapiens
  misc_feature 15, 23, 86, 148, 149, 168, 232, 256, 263, 288: n = A,T,C or G
acttaaacagcttangagtttantttaaaagttgtaggtgattaaaataatttgaaggcgatcttttaaaaagagattaaaccganggtgattaaaagaccttgaaatccatgacgcagggagaattgcgtcatttaaagcctaggtnncgcatttactaaacgcagncgaaaatggaaagattaattgggagtggtaggatgaaacaatttggagaagatagaagtttganggggaaaactggaagacagaagtnccggganggcgaagaaaagattggagaagatngggaaattagaagataaaaacatacttttagaagaaaaaaga

SEQ ID NO: 53408 - DNA, 310 bp, Homo sapiens
  misc_feature 149, 150, 154, 195, 221, 236: n = A,T,C or G
ctcctgcccccctttgaaaaaaaattaactataatatttacataaagcttataagggcaactattacaatcaaatcaggcttaattttcaggagattcttcagtaacttttattttttaaactaggattcctctagaaattaagcagannatgngaatgcgtaatactttaatttgctacaaatattaataaagnggacatccttactaataaaatatggnttacatggtaactgnaataatatttgaagtagatatttatgcagtggcctggaagatatacatagtattggaataaggaaaaaaaaaaa

SEQ ID NO: 53409 - DNA, 310 bp, Homo sapiens
  misc_feature 108, 112, 196, 231: n = A,T,C or G
caagatagcagggtatgtcacgcatctgatgaagcgaattcagagaggcccagtaagaggtatctccatcaagctgcaggaggaggagagagaaaggagagacaattntggncctgaggtctcagccttggatcaggagattattgaagtagatcctgacactaaggaaatgctgaagcttttggacttcggcagnctgtccaaccttcaggtcactcagccctacagttngggatgaatttcaaaacgcctcggggacctgtttgaattttttctgtagtgctgtattattttcaataaatctgggaca

SEQ ID NO: 53410 - DNA, 289 bp, Homo sapiens
  misc_feature 6, 26: n = A,T,C or G
caaggnctgtgagactacctattgtnggatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaaaaaaa

SEQ ID NO: 53411 - DNA, 130 bp, Homo sapiens
  misc_feature 13: n = A,T,C or G
gtaacaacacagnatggcttcactgaaacctgcttttgtaaattactttttttactgttgctggaagtgtcccacctgctgctcataataaatgcagatgtatagcaaaaaaaaaaaaaaaaaaaaaaaa

SEQ ID NO: 53412 - DNA, 206 bp, Homo sapiens
  misc_feature 145, 146, 162, 166: n = A,T,C or G
gaccgacaaaattccagttatttatttccaaaatgtttggaaacagtataatttgacaaagaaaaatgatacttctctttttttgctgttccaccaaatacaattcaaatgctttttgttttatttttttaccaattccaatggnnaaaatgtctcaatggngctntaataaataaacttcaacactctttatggtaaaaaaaaaa

SEQ ID NO: 53413 - DNA, 183 bp, Homo sapiens
gttctctacaaaaacgttaaaaagttagttgggcatggtagcatgtagtcccagctatgcaagaggctgaggtgggaagattgagcccagaagattgaggctgcagtgagctgtgattataccgctgcactctagcctgagtgacaaagccagacactgtcttataaaaaaaaaaaaaaaaaa

SEQ ID NO: 53414 - DNA, 320 bp, Homo sapiens
  misc_feature 16, 18, 33, 83, 146, 149, 281, 303: n = A,T,C or G
attgactacatatatntncatctgtagtttctnagaagggctattggattagtttgaactgtcaaatccttgcatacttctgngacacccctgcccattttctgtctttaattaaccaaggtgttaggtgtgactgtcacaactgngangggtttccagtaaactagaagtacgatatttgataattatatttgtatttcaccacctaaatgtaatgttgattcctcaagaatgaaatgaaggcactacattgaaatatgttttgtataaatttggcatgntgaacagcatttttagcatggnaagttcccttagctata

SEQ ID NO: 53415 - DNA, 223 bp, Homo sapiens
  misc_feature 17, 80, 141: n = A,T,C or G
atcacacgcatcctganacatggagccaaagacaaagatgactgaaaggaactttagctaaaatcttccagttacattgncttactctcttttacttctcagacacttcccccaccctcatagaacctgttgcaggcagcnttagtttcacagctttgcctcttctttttgatgtatttatttccagacctttctgccacttagcaccttgtataatcagact

SEQ ID NO: 53416 - DNA, 410 bp, Homo sapiens
  misc_feature 10, 13, 48, 133, 136, 171, 277, 306, 378: n = A,T,C or G
atacccttantgngatgatgtaaatagaggctagctacctaggcttgnctatagcaaccataatgttgatgtaagtaatgcggctactgaatcataagaaaatgccatctctttttagttgaaggaaaactgnggnagtaggtgccattgggtcattctgcagtgcactgnaacccattgtttcccctagtgccctcttttccctagggcattgctctcctattcccacgccttaacacagctctatacctagaagcagccagcccaggcatgcagncacatttaatcacatcccccttctagagngcttcaaaatgatgtagtccctcaacttgggctaaagaatctcaatctcttgaaatttattttttttaatgncatattcatctgggaaaatatctactggttgc

SEQ ID NO: 53417 - DNA, 120 bp, Homo sapiens
  misc_feature 34: n = A,T,C or G
aaacaaaaaacaagacctcttttctttagatggngccacctatgcccaccacaacagagattttacatggaaaccgggctcagtgagaactgatttcctgcccaatatttgtctttgggg

SEQ ID NO: 53418 - DNA, 340 bp, Homo sapiens
  misc_feature 30, 200: n = A,T,C or G
taaaatcctacatttattcccaggaatggnaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgncttgtaaactgtcttacttatgtgtgtaaacattttacattcacatgaaaagttattttcctttatataattggattcagaatcataagggacaggactgaaattattctacagtaaccagtaagaataagattcggccg

SEQ ID NO: 53419 - DNA, 222 bp, Homo sapiens
  misc_feature 40, 45, 126, 148, 149, 189, 204: n = A,T,C or G
aaataactgaaaaagagacacgaggaagaacgaatcattncaggncctgaaataaaatacactaggatttctactggagggggagaaacagaagaaactctgaagaaattgttacaagaagacacncccctgaggaagttgcaagccnnccaaaaagttcaaggatctagaagacgattaaggggaggncggtctcagtgaaanttcccccaaaaaaaaaaa

SEQ ID NO: 53420 - DNA, 380 bp, Homo sapiens
  misc_feature 110, 368, 374: n = A,T,C or G
ttccccagagcttaaacacacacaggggaatattctacctgtaagaatcgactgcaggtagattcttttttcattcttgttgttaggttgtatttggacttttgtctgcnggcctctaattcttaccataacatggagtctacgaatttctgagtggaagggaccatagaagatgttggccatttgggaaggaaataatgaattgcacgctttcctttgatctcgaggtatggaagcatctgagaaacaagacatgagtgaatcagatggtaatgagaacaacaggagaggaagaggaattggagaccagttgagccatctagtcacatgcagggctgggcaacagcagggcaagctcttcctagganggcagnttgctt

SEQ ID NO: 53421 - DNA, 299 bp, Homo sapiens
  misc_feature 152, 174: n = A,T,C or G
gaacctcgtgaaagctgtggttacagctgggcacggttggctcacacctgtaatctcagcactttgggaggctgagaggccccggatcacccgaggtcaggagttcaagaccagcctggccaacgtggtgaaaccccatctctactaaaaanacaaaaattagctgggcgtggnggtgcacacctgtagtcccagctactcaggaggctgaggtaggagaatcacttgaacccaggacagaggtcgcagtgagccaagattacaccactgcaccccagcattggcgacaaagtgaggcc

SEQ ID NO: 53422 - DNA, 470 bp, Homo sapiens
  misc_feature 49, 200, 206, 347, 373, 386, 403, 449: n = A,T,C or G
acacactcttcatctgaagcttcactgaaggtgatcatctgcagaccangggtcatgatgttcctgctgaggagtcttctgctgctttctattgtgttctccatggagggtgcagatgaggagcgacttagctgtgaaagaggctggagcaggtctggctctcgctgcttcaggtttttctccaggtctgtgaactgggncacagnaggagagaaactgtcagagtcttggagggaatctggcttctgtgcatgatcaagtggagaatgactttctgctgagtctggtgccgggctccacacgctgctggattggaggtcatgatggagaacaagatggacagtggntgtgggctgatggatctgtgtatggntacaccaactggngctcaggagagcctagnggcggggtctgagcactgcttggagatcaactggacatcgaaccgntgctggaatgatcagcgctgg

SEQ ID NO: 53423 - DNA, 284 bp, Homo sapiens
tgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtataaaaaaaaaaaaaaaa

SEQ ID NO: 53424 - DNA, 350 bp, Homo sapiens
  misc_feature 174: n = A,T,C or G
atctatctaaatgccgatttgagctcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagnggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtaga

SEQ ID NO: 53425 - DNA, 430 bp, Homo sapiens
ataaaacatgaaaggctagattaaaaggcatcagttatttgagcaactgctgaggtgcaaagtctccaaagtcttcactaacgtttgactgaaaatatggcctacattcagaaacaaaagagtttcagggtgtcagaatctgcatgcgacagaaattaagattaactctgtgataaaagattcgctgtgacagagaacaagctatgggaacaacttggtcaaaggtagtgttagccaagcctcattcctccatttcctcatctgtaatatgggaagattgtagctgattacctttagtgttccatcctaaatactaaacacccagatgcaccttttctaggaacttggaagattctgcttttcccaaccctcagacactgtcagtgctggggaaggtgacttcacttttgaaggcttatagcacagattg

SEQ ID NO: 53426 - DNA, 214 bp, Homo sapiens
  misc_feature 139, 140: n = A,T,C or G
atgagccttctgtaattcattgagcagttagctcatttgagataaagtcaagtgccaaacactagctctgtattaatccccatcattactggtaaagcctcatttgaatttgtgaattcaatacaggctatgtaaaatnnttactaatgtcattattttgaaaaaataaatttaaaaatacattcgaaaaaaaaaaaaaaaaaaaaaaaaaaaa

SEQ ID NO: 53427 - DNA, 479 bp, Homo sapiens
  misc_feature 25, 353: n = A,T,C or G
agactattcctcttcaagaacatgncaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcactgagcctcaagacactcactacattctttctggatgtttgctcacaggctccctgaggagcagaacctgtggagctggggagtgcgggtggtttctattcctaatattgngtgtcagtcctttttcgtgtgatggtgccttcagaataacgaatatttctgttctggacaatgattaaatcttatgagaaaatatggagggtatattaaattccttggccatttttgctaagcctg

SEQ ID NO: 53428 - DNA, 360 bp, Homo sapiens
  misc_feature 27, 28, 277, 328: n = A,T,C or G
gtctactcattactccaaaatcatgcnncatgctcacaaaaagtgttgaaaatatttttttcagaatgaatcagtccttattataaaaagttttaaccccctttttaaatgacattatagcttttcagcagtccaaagatggagtggaatcataaatgttttagaactgagttcttattctgaatagctctttattcctttgcttataaagagcttatatcatatttattcattttccttttgcctggatttttctgtaatttccctgaattaaagngcttattttccattctttcatttacacagcaaatatttactaagtttctgntttatgccaggtattattctgggggctacaaa

SEQ ID NO: 53429 - DNA, 300 bp, Homo sapiens
  misc_feature 6, 151, 152, 158: n = A,T,C or G
gggggncacactgtcataagatgtatagtcttctagtacttgttctttttattcagtgtcagaactaagattcatctacattattgtgtgtacctatagtccattcattggtgttgttgtataatagtgcattgtatgaatgcaccacagnntcccgnctcctatgtgaacaagtgataatgaaaacattctttattaacatttttgagaagcagcaaatgtgttgctttgagggatatttatagctttaaatgtttatattatgaagaatagctgaaaatcaatgcactaaatgtccca

SEQ ID NO: 53430 - DNA, 365 bp, Homo sapiens
  misc_feature 44: n = A,T,C or G
cagtcattgcagcttgatgcctaatcatgtatgtaataacaagnggaaggtaatagggccttctaatactgtatgggtactcctaagaattatttcattttggatataaagaagttatgaggcctcctgtcacattcacagctggttctccaaaataatttggttgtttcaaaaacaaatggtaatcatttggttggattcttcagtatcatgactagatcatgtggttttaccatagttgccaagtggtgggaggtagcatacctgaaaatgtacgtgtgtgtttgttgtattttttcacattttgtgaacaaagcacatttattaaaaattttaaattttctagcaaaaaaaaaaaaaaaaaa

SEQ ID NO: 53431 - DNA, 300 bp, Homo sapiens
  misc_feature 93, 156, 264: n = A,T,C or G
caacatgcgtatcgaaaagtgttatttctgttcgggacccatctatcctggacacggcatgatgttcgtccgcaacgattgcaaggtgttcangattttgcaaatctaaatgtcataaaaactttaaaaagaagcgcaatcctcgcaaaggtaggnggaccaaagcattccggaaagcagctggtaaagagcttacagtggataattcatttgaatttgaaaaacgtagaaatgaacctatcaaataccagcgagagctatggnataaaactattgatgcgatgaagagagttgaagaaa

SEQ ID NO: 53432 - DNA, 220 bp, Homo sapiens
  misc_feature 121, 151: n = A,T,C or G
aggaggagagagaaacgcaggttgctgcgtggttaaaaaaaatatttggagatcatcctattccacagtatgaggtgaacccacggaccacagagattttacatcacctttcagaacgcancagggtccgggacagggatgtctacctggnaatagaggacttgaagcagaaagcaagtgaatacgagtcagaagccaagtatcttcaagaccttctcat

SEQ ID NO: 53433 - DNA, 380 bp, Homo sapiens
  misc_feature 44, 45, 258, 330: n = A,T,C or G
tttaaagtgtttgttgcacagtttatttaatgtttcatcttatnngactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgnttgttttttaataagggaacttggtaaagtagttcctgtcagataggattttctcaagagacaatttaacgntataaagccttctaaaagtgaactaaatatttttataactttagtaatag

SEQ ID NO: 53434 - DNA, 440 bp, Homo sapiens
  misc_feature 12, 393: n = A,T,C or G
gtaaatacactntacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgngcaacagcagaaaagatgcttgcaagcagagtcagggtcaccagtga

SEQ ID NO: 53435 - DNA, 226 bp, Homo sapiens
agcaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaaa

SEQ ID NO: 53436 - DNA, 220 bp, Homo sapiens
  misc_feature 148: n = A,T,C or G
atgtaaacaattgcttttcacctaagctgctttggaagaactgatgcttgctgctaactaaagttttggatgtatcgatttagagaaccaattaatacctgcaaaataaagcatactgtggtacttctgtttgatctagtatgtgggnttttagattgatggattaaaaattaataaagatcatacattccatacctaaaaaaaaaaaaaaaaaaaaaaa

SEQ ID NO: 53437 - DNA, 230 bp, Homo sapiens
  misc_feature 30, 60, 78, 91, 98, 133, 199: n = A,T,C or G
gcctatatctcatagttctttaaatgaggnggaaaggcatttaatgagtttgtatagacncattttcagatacccacncagagaaactgcngaagagnagggcaaacacatttacactgtcctactaccatanatgatgttgaaattttgcaagggattactaaaaagtgtcaaatgagctaactataggatgggaagncatgtttttgcctacatttgctaattgaaga

SEQ ID NO: 53438 - DNA, 240 bp, Homo sapiens
  misc_feature 13, 51: n = A,T,C or G
cggatagctcagnccggtagtagcatcagcacttttaatactgagggtccngggttcaagtccctgttcgggcgtttgtagttttcgttactttaacctgctaaattatcccatcaagtcccaagagcggacatcgtaaacccttacatttcaagttgaattcaaatcatttttcactgggttcagaatatgctagatagacgtgttttcagggaggaaaaaaaaaaaaaaaaaaaaaaa

SEQ ID NO: 53439 - DNA, 360 bp, Homo sapiens
  misc_feature 346: n = A,T,C or G
cgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagngatccagttctaaa

SEQ ID NO: 53440 - DNA, 404 bp, Homo sapiens
  misc_feature 8, 55, 64: n = A,T,C or G
cttcaggnaacttagtagtaaattctagtaaagtctctaggaataaagtaaaccnaaggacggnctggtcagtcacacattctcaggtttaaccctatcttataaaagtcttagggggaaaagttgggagtttttcttgaactgtacatatttcacatacttccctagtcttggaggtaggggaaacagatctagagatgtttgagaatctctgtgtaacttagagtatacccacaatatgtagtaagtgtattcttttgagacagaggttgaggtgttacctagagcaccactctccctgttaatcttggaaatgaactaactggctgtaagagcttttgttgaaaaagttcatttcaaggctttgggttttctaattacttctccaaaaaaaaaaaaaaaaa

SEQ ID NO: 53441 - DNA, 210 bp, Homo sapiens
  misc_feature 39, 40, 59: n = A,T,C or G
ttatggccggaaacctaagtagacttaaagatttgagtnnattatttgtgtcatttacnagacgggagttttagttctgtttgattatatttcctacacaaacttcttatttaacaggatagcctactaaattaaatgtttcttatttcacttaactcatttgattaaactgtattctaaaacatttggggtttttccccctattcagtt

SEQ ID NO: 53442 - DNA, 420 bp, Homo sapiens
  misc_feature 7, 27, 335: n = A,T,C or G
acatatnactattctttaacctgaccntaatgccctcttaaacagaggcttccctctctgctacctcctgcctccaaagattcaaagtaaatagtcacgtcttcccttttaatttcttgcttagatttttctcacctttgcttcaatatcattttttgtttttcatctccatcattaattgatttacagttcatttttctgcatacagagtttttcctatccaagttgagaagctgtaaatcttagatccattgaaatgacagtgagaaatatttcattttatcccatgaatcatttgccatccttattgcagacaaatggcaaaattatggggnaccatgttttcataaattactctgccgcccccccacccccattcccaggtcatttcattatctgtttgggaaagactataagaat

SEQ ID NO: 53443 - DNA, 340 bp, Homo sapiens
  misc_feature 30, 103, 118: n = A,T,C or G
atgatctgaccaggcaacagcgaaaatggncattctcgctaacaactgcccagctttgaggaaatctgaaatagagtactatgctatgttggctaaaactggngtccatcactacagnggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaacattgaaaaaaaaaaaaaa

SEQ ID NO: 53444 - DNA, 440 bp, Homo sapiens
  misc_feature 48, 55, 201: n = A,T,C or G
atctaaagtatgggggaggatgtgtgtgggttatattttaggtaccanggcattncatataagggacttgagcatcctcagattctggtatctgtagaggatcctcaaccaatcccctgcaggtagtgagggatgattttattccatctcaaggtaaaactcctagaggtatacctatctaaacctatccttggtaacagncacatagagtgtgtctcatacattataaattacaaatttttagttaaaaattaatgatgctttattcctgtttgagtttctttattactcaaacttggcccacacagtggcaaaatgggagattttgtgctacaaatagtgttggggatgggggagtgaaaggttatttatgggagatttttaagtctattcctggattaataatttttcagggtgaaaaatgcctctccagaagatgt

SEQ ID NO: 53445 - DNA, 480 bp, Homo sapiens
agcaacatgagggaaattgtggagttagcctcctgtggtaaaggaatggaagaagatataacaccttacaccctttttcatcttgacattaaaagttctggctaactttggaatccattagagaaaaatccttgtcaccagattcattacaattcaaatcgaagagttgtgaactgttatcccattgaaaagaccgagccttggatgtatgttatggatacataaaatgcacgcaagccattatctctccatgggaagctaagttataaaaataggtgcttggtgtacaaaactttttatatcaaaaggctttgcacatttctatatgagtgggtttacctggtaaattatgttattttttacaactaattttgtactctcagaatgtttgtcatatgcttcttgcaatgcatattttttaatctcaaacgtttcaataaaaccatttttcagatataaagagaattacttcaaattgag

SEQ ID NO: 53446 - DNA, 310 bp, Homo sapiens
  misc_feature 23, 24, 173: n = A,T,C or G
aacatgcctctcgcagaggatcnncttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgntggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 53447 - DNA, 400 bp, Homo sapiens
  misc_feature 24: n = A,T,C or G
atccatttccatcggtccttacanccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattgg

SEQ ID NO: 53448 - DNA, 298 bp, Homo sapiens
  misc_feature 40, 187, 198, 220: n = A,T,C or G
ggaacaagcatgatcttgttactgtgatatttgaaatatncacagtactcactttttccaaatgatcctagtaattgcctagaaatatctttctcttacctgttatttatcaatttttcccagtatttttatacggaaaaaattgtattgaaaacacttagtatgcagttgataagaggaatttggnataattatggngggtgattattttttatactgnatgtgccaaagctttactactgtggaaagacaactggtttaataaaagatttacattccaaaaaaaaaaaaaaaaaaa

SEQ ID NO: 53449 - DNA, 420 bp, Homo sapiens
  misc_feature 249: n = A,T,C or G
tgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagnttaggttaaacctactgttgttagattaatgtatttgttgcttccctttatctggaatgtggcattagcttttttattttaaccctctttaattcttattcaattccatgacttaaggttggagagctaaacactggggatttttggataacagactggcagttttgcata

SEQ ID NO: 53450 - DNA, 380 bp, Homo sapiens
catatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaatgaactgctttgtgaagtatgcacacggagacagtg

SEQ ID NO: 53451 - DNA, 360 bp, Homo sapiens
  misc_feature 347: n = A,T,C or G
agaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataatangtttagacaagaa

SEQ ID NO: 53452 - DNA, 170 bp, Homo sapiens
  misc_feature 139: n = A,T,C or G
gtcttccaccggatatgtagtgaatgtctacgtgttgctaacgaagtcactcttaattaatatctgtatcctggaacaatattttatggttatgtttttctgtgtgccagttttcatagtatccatattttattactgnttattacttccatgaattttaaaatctgagg

SEQ ID NO: 53453 - DNA, 330 bp, Homo sapiens
  misc_feature 15: n = A,T,C or G
ctgagttgcagcttnctacttcaattgctgctggaggggaaggacttacggatgtctccccagaaacaaccaccccggagcccccgttttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttg

SEQ ID NO: 53454 - DNA, 300 bp, Homo sapiens
  misc_feature 270, 295: n = A,T,C or G
cttcttttcgccatcttttgtctttccgtggagctgtcgccatgaaggtcgagctgcgcagttttagcgggtacaagatctaccccggacacgggaggcgctacgcccaggaccgacgggaaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagncaaattccagagggccattactggngcatc

SEQ ID NO: 53455 - DNA, 420 bp, Homo sapiens
cttttgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaaattggctctgcttcagagggtgcccagagctccttgcaagaagtttaccacaagtctatgactttgaaagaagccatcaagtcttcactcatcatcctc

SEQ ID NO: 53456 - DNA, 395 bp, Homo sapiens
attctagtgctgagtaagaaacacgtttggtttggagagtccatggatggtggttttcagtttagctacggcaatcctgaacttcctgaagatgtccttgatgtgctgctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgaca

SEQ ID NO: 53457 - DNA, 300 bp, Homo sapiens
  misc_feature 285, 299: n = A,T,C or G
cgaagtgacagtttacaaaattattttctgcaaaaaagaaaaaaaagttacgttaaaaaccaaaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgngggagtcggggtang

SEQ ID NO: 53458 - DNA, 430 bp, Homo sapiens
  misc_feature 31, 56: n = A,T,C or G
cagtatcttttgtatagaattgtcactgacnctccctttttacatgttataagatnatcaaaaggtgccaagtttaccagataaaatagaggattctcagttacatttttatttcctctgagcaatgaataatgttttagtgcaaataggtgctgacagttgctgtttatctgaaattcaagtgtaactgagcaccctgtatttttgtttgtttaatctggtagccctaaagcatattgttctctctttctcagtcccacttctcaaattttggagtaaggaactggactgacacagtttaggtcatgtgtcctttttgagtttcacggtccactgccaggacaaggagttacattttttttaagagaaataataacttgtcttggggttagatacacagacaaacagatgaggacctaagcaggtttag

SEQ ID NO: 53459 - DNA, 131 bp, Homo sapiens
gctgaggcaggaggatcacttgcacctgggaggtcaagactgcagtgagccatgtcctcaccactgtaatccagcctgagttacagagtgagaccttgtcccaaaaaaaaaaaaaaaaaaaaaaaaaaaaa

SEQ ID NO: 53460 - DNA, 280 bp, Homo sapiens
  misc_feature 25: n = A,T,C or G
ctgtgacttgaaacccaaggagganctctttgattcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggccagtcactctcagccatagcactttgttcactgtcctgtgtcagagcactgagctccacccttttctgagagttattacagccagaaagtgtgggct

SEQ ID NO: 53461 - DNA, 140 bp, Homo sapiens
  misc_feature 39, 71: n = A,T,C or G
tgataggagcattttatttggaagatgaagcaaattaanagactgcttcagggagacacacccgtgaggangttgcaagccaacaaaaaagttcaaggatctagaagacgattaagggaaggtcgttctcagtgaaaatc

SEQ ID NO: 53462 - DNA, 190 bp, Homo sapiens
  misc_feature 112, 147: n = A,T,C or G
cacctgttacattccgggaccgcattgaagagatacgcctggagggcaatccatatcgtcctgggaaagcatccaaacagttttatttgcttaaaaagattaccgatagggncataccttttaacctctattggtacaacatataanatgaaagtacacctacactaatagtctgtctcaacaatgagta

SEQ ID NO: 53463 - DNA, 280 bp, Homo sapiens
  misc_feature 13: n = A,T,C or G
taattgtgactanacaaggtatgctttgccttatttccacatttaaactacctgttaatataagggatttgtagtatcagcttgttgagcaatgactttgaatctagttttcagtgatcagaagcagcagttattttgagtgtatgaatggaatgatgatcactgtgctataatgtactgaaaccaccatattacagaaatatttactacatattttccatctgtagtttctcagaggggctatggattagtttgaactgtcaaatccctgcatacttct

SEQ ID NO: 53464 - DNA, 190 bp, Homo sapiens
  misc_feature 21: n = A,T,C or G
agtctgatcagttctgcaagnatgcccatcaacaacaagtatggcccagtggggcaacaagcctgtatgctgagcaggaggcagacttgcagagcttgttttgtttcatcctgtccgtaaggggtcagcgctcttgctttgctcttttcaatgaatagcacttctgttaaaaaaaaaaaaaaaaaaaaaa

SEQ ID NO: 53465 - DNA, 179 bp, Homo sapiens
aaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaaaaaaaaaaaaaaaaaaaa

SEQ ID NO: 53466 - DNA, 277 bp, Homo sapiens
  misc_feature 27, 44, 96, 159, 242, 251, 252: n = A,T,C or G
atggttgtcattttctgagaatagagnttgggcctgcctgggcnaaccttcatggtttcttattccaaaggcttgattatattttttttctccagngattaaaaaatgcagcgaaaatccaatctacaagttcatatattggggatttctagacatagnctagttctaaaagaatgaccttgggggggcattttttaagtggttcatgtagacagattaatatattttttgaccaacattgnatttctacnntttatttcaagactggactttttca

SEQ ID NO: 53467 - DNA, 265 bp, Homo sapiens
  misc_feature 12: n = A,T,C or G
cataaaaagaancgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttgtgttgtctcacagaaagccttatcataaattccataat

SEQ ID NO: 53468 - DNA, 300 bp, Homo sapiens
  misc_feature 17, 23, 37: n = A,T,C or G
atttaggctttaaatgngcattntgggaaactcagcnttaatcttatttcattcttttgttgccattaaattgtaataagcttattttaaacttcagggtgctttctgagcccttattggcatcataaattttgttcccacatttttaaagtaccttgacagacacacaggttggctgaactgacaggccgccccatgagagttgtgggctggtatcattcccatcctcatataactgtttggccttcacatgttggtaagtatcatggggttgcaatgtttattgttttcagaaattaa

SEQ ID NO: 53469 - DNA, 166 bp, Homo sapiens
  misc_feature 25, 59: n = A,T,C or G
attatggagatgaaccaatggattncaaaatcaacaccgatgagattatgacttcactnaagtctgttaatggacaaatagaaagcctcattagtcctgatgattctcggaaaaaccccgctagaaactgcagagacctgaaattctgccatcctgaactcaagag

SEQ ID NO: 53470 - DNA, 419 bp, Homo sapiens
  misc_feature 19, 79: n = A,T,C or G
aacaacttcggtggtggcnctgcgcagtaccagacttcgctcgtactcgtgcgcctcgcttcgcttttcctccgcaacncatgtctgacaaacccgatatggctgagatcgagaaattcgataagtcgaaactgaagaagacaggagacgcaaggagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaaggttggatcaagtttaaatgactgtgctgcccctttcacatcaaagaaactactgacaacgaaggccgcgcctgcctttcccatctgtctatctatcttggctgca

SEQ ID NO: 53471 - DNA, 330 bp, Homo sapiens
  misc_feature 10: n = A,T,C or G
gggatgctgntgtcatggagctgtgggagttggcacctctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaacctagaagtccagggttgcttggtttactggtttataagaaatctgaaagcacctctgacattccttttattaactcacctctcagttgaaagatttcttctttgaaaggtcaagaccgtgaactgaaaaaagtgttg

SEQ ID NO: 53472 - DNA, 440 bp, Homo sapiens
  misc_feature 238, 408: n = A,T,C or G
cacttgtgatgtactcttggtttgcattggccgacgaccctttactaagaatttgggactagaagagctgggaattgaactagatcccagaggtggaattccagtcaataccagatttcaaactaaaattccaaatatctatgccattggtgatgtagttgctggtccaatgctggctcacaaagcagaggatgaaggcattatctgtgttgaaggagtggcttggtggtgctgtgcncattgactacaattgtgtgccatcagtgatttacacacaccctgaagttgcttgggttggcaaatcagaagagcagttgaaagaagagggtatttgagtacaaagttgggaaattcccatttgctgctaacagcagagctaagacaaatgctgacacagatggcatgggngaagatccttgggcagaaatcgacagacagag

SEQ ID NO: 53473 - DNA, 420 bp, Homo sapiens
agtacatgaagccatggagtggaggcgaaaaattacgaatagattgcaaaagttgagaagctcaaaccattagaggtagagctgcgaccgcctagaagacctttcagaatctattgttaatgattttgcctacatgaagaagagagaagaggagatgcgtgataccaacgagtcaacaaacactcgggtcctatacttcagcatcttttcaatgttctgtctcattgggctagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagcttttcttgccagaactgat

SEQ ID NO: 53474 - DNA, 330 bp, Homo sapiens
  misc_feature 18, 30, 72, 89, 301: n = A,T,C or G
ttatggcgcgggcatgtngtgtcgcatgtntattactgatttacaagactaacctttgttcgtatataaagntacaccggtgctgcttnacattcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcaganaatagcagtttcactgccaacttttagtg

SEQ ID NO: 53475 - DNA, 260 bp, Homo sapiens
  misc_feature 83: n = A,T,C or G
cttgtacatggttggacaagctttcttgtctttgctggaaagaaaatgactacttactaatatattttgggaaaaatatttgnaagaatattaataagcttgttttccaggacctatttaagaaaaataccacgttttaatgcagattctggctattccatccattctgattcagaaagtcaggtaagattgaatagatacaatacacactattttaatttagttttcaaatagtagctaaaaaaaaaaaaaaaaaaaaa

SEQ ID NO: 53476 - DNA, 240 bp, Homo sapiens
  misc_feature 8: n = A,T,C or G
ttaacaanatgtggcaattattttggatctatcacctgtcaccataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacataaataaaaaaaaaaaaaaaaaaaaaaa

SEQ ID NO: 53477 - DNA, 158 bp, Homo sapiens
  misc_feature 10, 35: n = A,T,C or G
tgaatatcgnacacgcaagggctgtgagtactacnctattgtaggatattgcaccctatgacattgggggtcctgatcaagaatttggtgtggaccgttggcccctgtttgctttttataaaccaaactctatctgaaatcccacaaaaaaaaaaaaa

SEQ ID NO: 53478 - DNA, 166 bp, Homo sapiens
ttcatgtgggccccttgctgactatattccaaccacttcagggttgtttgtaatgaccgttatagagaagggctcgacctgcagaagaaactggggtgtttttattctcattcaacaaacccaaataaaaacagtatatgtaaccaaaaaaaaaaaaaaaaaaaaa

SEQ ID NO: 53479 - DNA, 246 bp, Homo sapiens
  misc_feature 153, 223: n = A,T,C or G
ctggctgggccatgcttgtgaagtgatgtgtgtctctgatttaacggattcactgttttctctgctaattgagagagcgttatttacattatttatttggttttgacacaagtgctttcagtgttttatcctagctaatggcttcttaaaggnaataaaacccttccaacgtaattggtcagataaaactttttttcttgtatgcttaaataaagcaattagngaagcactttctatccaaatgac

SEQ ID NO: 53480 - DNA, 340 bp, Homo sapiens
  misc_feature 37: n = A,T,C or G
gcgatccatgcccatccgaaaggttgatgaagttcanggttgtaccgtggacacctataaaggtcagcaaattggcaaagtagtccaggtttacaggaagaaatatgttatctacattgaacgggtgcagcgggggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattta

SEQ ID NO: 53481 - DNA, 157 bp, Homo sapiens
  misc_feature 50, 127: n = A,T,C or G
atgaaggaaaaaagaccacccattttggtagaaggtggagatgctggcancagggaggaccagatcaacaggcttattagaagaatgaactaaggtgtctaccatgattatttttctaagctggttnggttaaataaacagtacctgctctcaaatc

SEQ ID NO: 53482 - DNA, 320 bp, Homo sapiens
  misc_feature 128, 177, 280: n = A,T,C or G
gtattttcacatagccagccaaaaaaaactttaaggctaaaaacaaagcaaaaccagttaccactaatcttaagaagataaacattatgaatgaggaaaaagttaacagagtaaataaagcttttgtnaatgtacaaaaggaacttgcacatttcgcaaaaaaggcatttcacttgnaccctctgcagaaagaactgattcctcagcagcgtcattgaaagcaaaccagttaatgttgatgaagctacaagattaatggctctgttgtaatatactgggngatgcatctaattctccacaaagaccaataaattggatgt

SEQ ID NO: 53483 - DNA, 400 bp, Homo sapiens
  misc_feature 10, 12, 347: n = A,T,C or G
acagcacggntngtttttcctttagtaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctaanaagtttgtcactgacttgtgttcctgaactatgacacatgaatatgtgggcta

SEQ ID NO: 53484 - DNA, 350 bp, Homo sapiens
  misc_feature 11, 239, 300: n = A,T,C or G
tatgatcaaantctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagnctggatttttgaggattttaggaaaggagagctattaaaaaactgggggatttctcaatgngactaactctaatttttcctaattataactgcctttaaattaacataata

SEQ ID NO: 53485 - DNA, 173 bp, Homo sapiens
  misc_feature 134: n = A,T,C or G
atctctagtgcaaaatacaaaaattagccggacgtcatggtacatgcctgtatgtcccagctactcaggacgctgaggcaagaattgcttgaactcgggaaaccaaggttacagtgagccaaggttgcgccacngcactccagcctgggtgacaagagtgagactctgtctct

SEQ ID NO: 53486 - DNA, 390 bp, Homo sapiens
  misc_feature 74, 134, 139, 293, 347, 364, 376: n = A,T,C or G
tccaatgtgtttgctatgtttgaccagtcacagattcaggagttcaaagaggccttcaacatgattgatcagancagagatggtttcatcgacaaggaagatttgcatgatatgcttgcttcattggggaagantccanctgatgagtatctagatgccatgatgaatgaggctccaggccccatcaattttcaccatgttcctcaccatgtttggtgagaagttaaatggcacagatcctgaagatgtcatcaggaaatgcctttgcttgctttgatgaagaagcacctggnccattacagggaagattacttgagagagctgctgacaaccattgggggatcggnttacagatgaaggaagnggatgagctgtncagagaagccccta

SEQ ID NO: 53487 - DNA, 193 bp, Homo sapiens
cacagactttgcgaaacgctacgccatggtttatggatacaatgctgcctataatcgctaccttcaggaagcgccgagggaccaaatgagactgagggaagaaaaaaaatctctttttttctggaggctggcacctgattttgtatccccctgtagcagcattacctgaaatacatagggcttatattcaaaa

SEQ ID NO: 53488 - DNA, 320 bp, Homo sapiens
  misc_feature 257, 268, 287: n = A,T,C or G
agaagggtttaaatataattttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattggntaagttcttgncattatgtgaaagcatagnatttaaactttgatctcattgattcagcaactg

SEQ ID NO: 53489 - DNA, 462 bp, Homo sapiens
  misc_feature 88, 410: n = A,T,C or G
atgaaaacttatgacctcttcctttaggagggagttatctaaaagaaatgtctattaaggtgatatatttaaaaatatttttgggtgntcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttacctaggtaacttcatattgctgagagaattatggaacttacattgttcaattagaatagtggttctgcaaaaatatttataaaacttctcaaggatactgctactgtaatttnttatgaagataaggtggtattttttcaataaagcatttattaaactaaaaaa

SEQ ID NO: 53490 - DNA, 410 bp, Homo sapiens
aaactcggtggtggccacctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgccttgcctttcccatctgtctatctatctggctgg

SEQ ID NO: 53491 - DNA, 160 bp, Homo sapiens
  misc_feature 2, 37, 96, 105, 125, 135, 141: n = A,T,C or G
tngtaaactatggactccaggttataatgacgtgccnatgtagattcatcagctgtagcaaatgaaccactctggtggaggatgttgataatgggngaggctgtncttgtgtggggacaggggcntatatgaaanctctgnactttactctcatttttgc

SEQ ID NO: 53492 - DNA, 402 bp, Homo sapiens
aatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctactcttaataaaattacattgaattgatttttagaggtaatgaaaacttcctttctgagaagttagtgttaaggtcttggaatgtgaacacattgtttgtagggctatccattcctctcctgagattttaacttactact

SEQ ID NO: 53493 - DNA, 270 bp, Homo sapiens
  misc_feature 203, 248: n = A,T,C or G
ggttgaggaatttccagggtttcacaaaggccagattttatttcagttactgagaagagaaagaaaatgtcttctgaaagaggtgaactcagtcattaccaatagaaaaagtatccactgtatttatctcttatacaaacaggaaaaatataacattttcccccttagaataatatatatatatatattataaaacttaaggntctatttgtatgtatcccgaacaacaaaatctggaaaccaacatngaaactctattattcacatgtt

SEQ ID NO: 53494 - DNA, 277 bp, Homo sapiens
atatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcaaaaaaaaaaaaaaaaaaaaaaa

SEQ ID NO: 53495 - DNA, 260 bp, Homo sapiens
  misc_feature 252: n = A,T,C or G
gggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaagggttttttttgtacgcaattctcgattctttgaagagatgacaacaaattttggntttctact

SEQ ID NO: 53496 - DNA, 130 bp, Homo sapiens
  misc_feature 56: n = A,T,C or G
gctgaggtgagtaggatcacttgagcccgggaggttgagtctgccgtgagccaagnatcgcaccacagcactcctgcccgggtgatagaatgagaccctgtctcccgaaaaaaaaaaaaaaaaaaaaaaa

SEQ ID NO: 53497 - DNA, 270 bp, Homo sapiens
  misc_feature 3, 17, 36: n = A,T,C or G
atnaaaactcctgagcnaacaacttaaatatgaacnagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaaaaaaaaaaaaaaaaaaaaaaaa

SEQ ID NO: 53498 - DNA, 500 bp, Homo sapiens
  misc_feature 367: n = A,T,C or G
aaagtgagtgattcgaaagcatggcgtcggtggtgttggcgctgaggacccggacagccgttacatccttgctaagccccactccggctacagctcttgctgtcatgatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtggggtgttggggaagaataaatgtctgtatgcccttggaagaggggatagtccgctacactaaggaggtctaccgtgcctcatcccagaaacacggaggcttgnggatctgatcaccaggctgcccaagggtgcctgtgctctacaagacttttgtccacgggggttcctgccaagccttgagggcccccttcaaaactggaagctatgcttttgaaggtccctgttgagggccatc

SEQ ID NO: 53499 - DNA, 100 bp, Homo sapiens
  misc_feature 93: n = A,T,C or G
gttgaggctgcagtgagccaagattgagccactgcactctagccagggtagccaaagtgaggccctgtcgggaaaaaaaaaagagagcgaganaggcatg

SEQ ID NO: 53500 - DNA, 259 bp, Homo sapiens
cacaagaagaaacgcctggtgcagagccacaattcctacttcatggatgtgaaatgcccaggatgctataaaatcaccacggtctttagccatgcacaaacggtagtttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgaaaaaa

SEQ ID NO: 53501 - DNA, 370 bp, Homo sapiens
  misc_feature 319, 321: n = A,T,C or G
tttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgactggngngttttcacttttgctttcagaactacgacttgaatgtgatcgattacaa

SEQ ID NO: 53502 - DNA, 550 bp, Homo sapiens
aaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattaggtctaatcatgttttctgaaaatataaccagccattggctatttaaaacttgtaatttttttaatttacaaaaatataaaattttggaagacataaacccagttgccatctgcgtgacaataaaacattaatgctaac

SEQ ID NO: 53503 - DNA, 400 bp, Homo sapiens
  misc_feature 14: n = A,T,C or G
gcttggaagaggancttgggcgcccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaaggtgtttggaaagttttgagcattgcaatttcaacgacgtcacaacccgcttgagggaaaatgagctaacgtactactgctgcaagaaggacctgtgtaactttaacgaacagcttgaa

SEQ ID NO: 53504 - DNA, 300 bp, Homo sapiens
tggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaa

SEQ ID NO: 53505 - DNA, 116 bp, Homo sapiens
  misc_feature 63: n = A,T,C or G
ctgataggaggcactttgggtcttgaggatgttcaacaccccccagtgtaaggggaaataccnagggcaggaggatgggagtgggtgggtggttgagcactctcatagaggcaggc

SEQ ID NO: 53506 - DNA, 303 bp, Homo sapiens
ttattttgcctttttaaactctttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgcttgttgtgcagtgtgcctgtcactactgggctgtactccttggatttgcatttttggatttttgtacaaagtaaaaaataaactgttattgagtaggaaaaaaaaaaaa

SEQ ID NO: 53507 - DNA, 450 bp, Homo sapiens
  misc_feature 322, 436: n = A,T,C or G
ttctgataaagttctctctggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataaatttatgatgactcagtggtgccagagtaaagnttctaaaataacattcctctcacttgtaccccactaaaagtattagactacacattacattggaagttaaacacaaaattatcagtgtttttagaaacatggagtccggactgngtaagtaaaaagta

SEQ ID NO: 53508 - DNA, 202 bp, Homo sapiens
  misc_feature 29: n = A,T,C or G
acttttccctaagaatagtttaatcacantactcccttttaaattttttaagcctttaaacgtattattttcagtctgggcttgggggctcacacctgtaatcctagcagtttgggaggctgaggctaggggatcacttgagcccaggagtttgagaccagcctgggcaacataagaagacctcatttctgaaaaaaaaaaa

SEQ ID NO: 53509 - DNA, 200 bp, Homo sapiens
  misc_feature 26, 41, 83, 191: n = A,T,C or G
ctgactaaccaaccacttgtgttctnttcttttgaatcctnagcccctctgcagagcaatgactgtgctcaccagtaaaaganaaccttttctttctgaaatagtcaaatacgaaattagaaaagccctccctattttaactacctcaactggtcagaaacacagatttgtattcttatggagtccccagnaagacgaaa

SEQ ID NO: 53510 - DNA, 300 bp, Homo sapiens
cccgccgagcagtcaaaattccagagggtcattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtgggaaaacgctaaactggcagattagatttttaaataaaagattggattat

SEQ ID NO: 53511 - DNA, 163 bp, Homo sapiens
tttttttaagaaaaggacacgttatgttagcatctaggtaaggctgcatgatagcattcctatatttctctcataaaataggatttgaaggatgaaattaattgtatgaagcaatgtgattatatgaagagacacccaaaaaaaaaaaaaaaaaaaaaaaaaa

SEQ ID NO: 53512 - DNA, 340 bp, Homo sapiens
  misc_feature 30, 72, 100, 256: n = A,T,C or G
cagcctaaaggtaacttttacacaactacntttcagtaatttgtgtgcactgaaaattttgaccgtgctccntcacatgagatcaagtgtaaattttccntttgtgtgtcatatcagtgttcaaaaagttttggattttcaagcatttcagattttagattttcagattagtaatgctaaacctgtatttaaataatattaaaaatactcgagtctgaatttagagagttttcatgtaagtatgtacatttataanggaagattttgctatgcttgagcaacacctcatctgatttggaagttggtagccaatatgtttaggtaactcaaaggtttgaaa

SEQ ID NO: 53513 - DNA, 400 bp, Homo sapiens
  misc_feature 16, 288, 290, 367, 391: n = A,T,C or G
gtaccctgtcactcantgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagngnttattttgcatgatctttaacaaatgttttaagcaattttaaaaaggcaggatggtattgacattatacactgaagncttaacattttaaacatttatagngcttatttg

SEQ ID NO: 53514 - DNA, 190 bp, Homo sapiens
gaagactgaggatgaggatgaaagaaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaaaaaaaaaaaaa

SEQ ID NO: 53515 - DNA, 600 bp, Homo sapiens
  misc_feature 410: n = A,T,C or G
aaaaactttcttctttaaggattctcagtactggcgttttaccaatgatataaaggatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgngggaggaggacttccaaatgtgggtacctcagctatatcactgcccaacatcagaaaacctgacggctatgattactatgccttttctaaagatcaatactataacattggatgtgcctagtagaacagcaagagcaattactactcgttctgggcagaccttatccaaagtctggtacaactgtcctta

SEQ ID NO: 53516 - DNA, 350 bp, Homo sapiens
  misc_feature 31, 42: n = A,T,C or G
gtaatggagaggagaaggagccaggttaganagaaatgtttntgttgttatgttgggaaaggtttggatgcatctgatgtacggtaggaagacatttcaaattgtgacaaagaaaagtcagcgacgccaggcacagtggctcactcctgtaatcccagcactttgtgggtggatcatcacttgagctcagtagttcgagaccagtctggacaaaatggcaaaaccctgtctctactaacaatacaaaaactagctgggcctggtggtgtacaccttgtagtcccagctacttgggaggctgaggcaggagaatcacttgaacccaggaggtggaaggttgcagtgagccc

SEQ ID NO: 53517 - DNA, 260 bp, Homo sapiens
  misc_feature 55, 214, 258: n = A,T,C or G
ttttcccaataaggaaatagcattgaaatgttaaaatacaatttctgaaagttantgttttttttctatcatctggtataccattgctttatttttataaattattttctcattgccattggaatagatatctcagattgtgtagatatgctatttaaataatttatcaggaaatactgcctgtagagttagtatttctatttttatataatgnttgcacactgaattgaagaattgttggttttttcttttttttgntt

SEQ ID NO: 53518 - DNA, 210 bp, Homo sapiens
  misc_feature 9, 23, 24, 25, 44, 60, 61, 84, 112: n = A,T,C or G
gctttcgangcgaaaagtcctannnagtagatagacccctcccnaaacctggagtgactnntatggatgccccccacccttacnacacattcgaagaaacccgtatacattnaaatcttagacaaaaaaaggaaggaatcgaaccccccaaagctggtttcaagccaaccccatggcctccatgacttttccaaaaaaaaaaaaaaaaaa

SEQ ID NO: 53519 - DNA, 460 bp, Homo sapiens
gttgcttggcggtcgtggttccggaggttcctcgggatgtcggtggccttcgtacccggactggctgaggggcaaggcggaagtcaatcaagagactattccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcaaaacgtgaaaatgtgaagaaagctactaacttagctgtattctcatgt

SEQ ID NO: 53520 - DNA, 340 bp, Homo sapiens
  misc_feature 43: n = A,T,C or G
cctggggcgcagcactgctgatgaaaagtattaatagcttcantttcattataaacataagtaactcccaaacacttatgtagaggactaaaaatgtatctggtatttaagtaatctgaaccagttctgcaagtgactgtgttttgtattactgtgaaaataagaaaatgtagttaattgcaatttaaagagtattccacataacttcttaatttctacattccctcccttactcttcgggggtttcctttcagtaagcaacttttccatgctcttaatgtattcctttttagtaggaatcccggaagtattagattgaatggaaaagcacttgccatct

SEQ ID NO: 53521 - DNA, 330 bp, Homo sapiens
  misc_feature 293, 319, 324: n = A,T,C or G
gacagggcaaaacctcctactggttgcattggaaatcagccaagttttactaatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgnatgtttctctttgattatttgcatgntatgnttaata

SEQ ID NO: 53522 - DNA, 140 bp, Homo sapiens
ttcttctttttctaactgactgcggaatccttccgttgcttctgcacatcgacttgcgtagcatcagtgggcaaacagagaaaaaggaaggatatgatcagagcattgtgcaactacagtggcattaactccttccctcg

SEQ ID NO: 53523 - DNA, 310 bp, Homo sapiens
  misc_feature 49, 59, 61, 83: n = A,T,C or G
tctttgcattgacaaaaaaaagtcaggatttttggaaatctcttcttcntttcctttcntnttcttcagaaagtcagaaagangattcagctaaatttgacagtaatggaaagaaagattctgcttctgttttttcaccatcattttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaaga

SEQ ID NO: 53524 - DNA, 221 bp, Homo sapiens
  misc_feature 31, 62, 73: n = A,T,C or G
ccaagacaaaggaaaggcatcccctcctganacagcagaaggttgatcttttgctgggaaanagctggaaganggacgcacccttgtctgactacaacatccagaaaagagtccactctgcacttggtcctgcgcttgaggggggggtgtctaaagtttccccttttaaggtttcaacaaatttcattgcactttcctttcaataaagttgttgcattccc

SEQ ID NO: 53525 - DNA, 130 bp, Homo sapiens
  misc_feature 13, 88: n = A,T,C or G
ttcttggacaagnggcgggcccctgaacctcactgaagggcttccaatgtgctgccccccttctttaatacttcaccaataaattctnctttcctgtccaccccaaaaaaaaaaaaaaaaaaaaaaaaaa

SEQ ID NO: 53526 - DNA, 260 bp, Homo sapiens
  misc_feature 18, 35, 112: n = A,T,C or G
gagctggaggctgacgantggcggtttaagccccntcgagcagcttgcttgggaattcacccccctcttcaggttgatacctgcctggatggtcaccttcttggtgcgcagnaagtgcaaagccagtgggggactttctcacagcttacatagccatccagagatccacagctacgtcactgaattgttaatgcacatttgtacttggtttctctgtatctattcacaggcaacaaatacttatattgtgtgatcttcca

SEQ ID NO: 53527 - DNA, 440 bp, Homo sapiens
  misc_feature 438: n = A,T,C or G
ggtgtccaagggagagaatacagtcatgagttcttagtttctgttattggttgggccaataaagccccttcatcatccttcttttctgcttatcactagagacagaaactaaaaaccatggcttcaggctgctaaaagcctaaaacaaaacagaacaacaacaacaaataaggcaggttggacaagcttgctgagtatttgggagcctttttcaaaagtctgatttgggggaagtaaagtcacttattttaagctaccttagtatagcacctaaagagttactttgtgaattttgtatggctgcaattgaaaaaaaaaattgctcactttcacttgcatttaaaaatcagagctctaaaagttaattcttgttttttattgggaaactctgagagaaacattaattgatgagggtaataattttgggataaagccagnga

SEQ ID NO: 53528 - DNA, 275 bp, Homo sapiens
  misc_feature 243: n = A,T,C or G
tgcccctgggcagccagcatttcatttgtaagtttcccttctttgaaaactggtgtgtggggtggttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggntattaaaataactatgaaattccccaaaaaaa

SEQ ID NO: 53529 - DNA, 1026 bp, Homo sapiens
  misc_feature 253, 254, 255, 256, 259, 267, 277, 279, 280, 281, 282, 283,284, 285, 289, 291, 293, 295, 297, 299, 301, 307, 310, 311,313, 315, 316, 317, 326, 331, 332, 336, 338, 339, 341, 342,343, 344, 345, 346, 347, 349, 351, 364, 367, 376, 381: n = A,T,C or G
  misc_feature 390, 392, 393, 396, 397, 398, 399, 400, 401, 402, 403, 404,405, 406, 407, 408, 409, 410, 411, 412, 413, 414, 415, 416,417, 419, 420, 422, 423, 424, 425, 426, 429, 430, 433, 435,437, 438, 441, 447, 448, 450, 453, 454, 455, 460, 463: n = A,T,C or G
  misc_feature 464, 465, 466, 470, 471, 474, 478, 479, 480, 482, 485, 486,492, 494, 495, 497, 498, 499, 503, 504, 506, 509, 511, 513,514, 515, 517, 518, 521, 523, 524, 525, 530, 531, 535, 539,540, 542, 543, 548, 549, 552, 554, 555, 557, 559, 566: n = A,T,C or G
  misc_feature 567, 568, 571, 575, 576, 577, 578, 579, 582, 585, 587, 588,590, 591, 592, 593, 594, 595, 597, 611, 616, 623, 627, 630,634, 637, 638, 640, 644, 646, 648, 651, 657, 660, 666, 667,672, 675, 679, 680, 686, 689, 692, 693, 697, 699, 700: n = A,T,C or G
  misc_feature 703, 704, 705, 711, 713, 714, 716, 717, 718, 719, 721, 724,729, 731, 738, 744, 755, 756, 759, 777, 778, 780, 781, 783,786, 787, 788, 791, 794, 798, 809, 810, 812, 815, 819, 830,831, 833, 835, 839, 842, 847, 849, 854, 855, 864, 865: n = A,T,C or G
  misc_feature 868, 870, 871, 877, 881, 882, 886, 890, 891, 892, 906, 907,908, 910, 917, 919, 928, 932, 945, 947, 948, 952, 954, 968,972, 973, 985, 990, 992, 995, 1014, 1016, 1019, 1020, 1023,1025: n = A,T,C or G
tataatctcttgaatttggtatcttattaatgagttttaaagatgtaaaacctaaccttttttaaagctccattgtcttatgtttttagaggcttttccgtaaacatatatcttacatataataaacttttcaaatcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnntgnggggggcnccccccccgncnnnnnnntttngngnanananangctcgncgnncncnnnccggcgaangcccnncctngnncnnnnnnnangnggagggggggggngcnaaaccaccncgcgnggggggggngnnggnnnnnnnnnnnnnnnnnnnnnncnngnnnnncgnncgngncnnccnccccgnncnccnnnggcgnccnnnncggnnggncggnnngnggnnggggcncnngnnnggcnngnggncncnnngnngcngnnnccggnncggncggnngnnggggnnacngnngngnggggcgnnnggnggcnnnnnggnggngnncnnnnnngngggcgcccccgcgncgcgncgcgcgntccnccncccngcnncnccgnancnccngccggnggngcgggnnccgcnggnggcnngggcgncgngcnncgcngnnggnnngcgggntnngnnnncntcnccgangngggccgncggggnccacggggggnnggnggggcggcggccggggcnngnngngcnnngcnccngcgnaagaggagcgnncnggngggngcgggcggggnngngngtgnggnggggngngcccnngccgggcgnncgngnnggggcngggnngggnggcnnnggtcggggggcgcnnncncgcgcgntncactgcgcngcgngcccgcccgccgntnnccgngncgcgcgacggcccncgtnntcacgcgcggcnggcgngngcngcagccgcccgccgcgcgnanccnngcncng

SEQ ID NO: 53530 - DNA, 400 bp, Homo sapiens
  misc_feature 353: n = A,T,C or G
cttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcataccgttagngctagatactagaaattttcacttttccactgatcaggagagacaga

SEQ ID NO: 53531 - DNA, 370 bp, Homo sapiens
agcaatagattagttagaaaaaagtgtttttgacattataaatgattctttcaatttgtgtctaaaagtggaaaatactagaaagcttaacatttattattgtattcagaccagtatttcctccagatgacctttattacaacaaagataatttaatgaagatctctccaatggtaaagctgatggctttgtgctattacaatatccttcaaataaagtgacgatctggtggaaagaacaactaaagcaaggattaggaagaaaacagttaataccttcattttggtctcactctgcattaagagttttcattgtgttaaggatttattatacattaagtaatttaatgttcatttaataataaatggat

SEQ ID NO: 53532 - DNA, 500 bp, Homo sapiens
atgttaagtatggtcgcagtaaatgaaattgtgtttaagactaaatttactaccgttttgaacagacattcccagatcattcttatattgtcagataacacttgtgtataatatcactttggatcatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctcctttttgttttacagagcaagggtcactttgatttgctagctgggggcaggaattggcaccattaccccag

SEQ ID NO: 53533 - DNA, 189 bp, Homo sapiens
  misc_feature 160: n = A,T,C or G
atttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcntgagaaaaaaaaaaaaaaaaaaaaaaaaa

SEQ ID NO: 53534 - DNA, 470 bp, Homo sapiens
cttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatt

SEQ ID NO: 53535 - DNA, 400 bp, Homo sapiens
  misc_feature 16: n = A,T,C or G
tttggatgctgctgcnttcaggaactgagtgtctaggagactgagaacctctagaagaacttccaggctgctagcaggatcttggagagttcatctctgattttaaccggcacaggtttctcaactgctcagattttgacacgtgtttatctgaagtagaattaacaaacagtcctgttcaatcattaatccagcacctcacatttagagcatgtacccagctttccattaatcttctctatcttttcatggcagcaggtgaaaaatataattgtagggaaagtataattgcctttaaattttatcacacatcagtaaaggatctagaagatttggggtaagaaattacaaatgcaagaatgatgtgcatattttaagtgtaaatattcaaattaacttg

SEQ ID NO: 53536 - DNA, 460 bp, Homo sapiens
cgcaatagtatatagtaccgcagggaaagatgaaaaattataaccaagcataatatagcaaggactagccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccgccaattaagaaaagcgttcaagctcaacacccactaccta

SEQ ID NO: 53537 - DNA, 300 bp, Homo sapiens
tgatttaatccttcgtaaaatgaatttcttgtgaaataaaatgtttatactgtctgatctgatatatattgcctttttcatttggacaactaaaattgattaattacccacactgaaatttgttttaaccagttgattgtggaggattagatttaatgtcacagttatttgtcctaagataagatttaaagtatattatgaggcatgtaaaaggaggtttaatgtgtgttagaaacagaaaaaacatctgagaaaatttcgaatcacatattactttgccctattaaaaaaaaaagttag

SEQ ID NO: 53538 - DNA, 415 bp, Homo sapiens
atgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaatttttatttccagctcctgttccttggaaaatctccattgtatgtgcattttttaaatgatgtctgtacataaaggcagttctgaaataaagaaaattttaaaataaaaaaaaaaaaaaaaaaaaaa

SEQ ID NO: 53539 - DNA, 450 bp, Homo sapiens
  misc_feature 3, 299, 444: n = A,T,C or G
aangcgagtacctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgntgagcctaactgcagatccaagaggatgctggccattaagagatgcaagcattttgaactgggaggagataagaagaagaaagggccaagtgatccagttctaaactttgggatattttttcttcaattttgaagagaaaatggngaagcc

SEQ ID NO: 53540 - DNA, 500 bp, Homo sapiens
  misc_feature 8, 470: n = A,T,C or G
gatcaagnaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctatttttaactacctcaactggncagaaacacagattgtattctatgagtccc

SEQ ID NO: 53541 - DNA, 400 bp, Homo sapiens
  misc_feature 390: n = A,T,C or G
caatgatcaaatgaaataatgttttataattttaaagcaccatagaaagatttaagttctatgtatttttaatttttaattatgatttctttctcgactaacatatgtatgaggctttttttcccatttcctagcgtgtatatttttaaattctgtgtttattgattcctgttttaattgaatttgaattgtggacagaaaataggtacatgttaagactgatctgttaatatttgttgagatttgctttatgacctagattataacctgtttctgtaaatgtttcatgattgcttgaaaagtatgcttgttttttagttgttggatgtccattagaccaaagttgttaattttgtagttcaaattttttccattttactattcttttgncttctacttg

SEQ ID NO: 53542 - DNA, 530 bp, Homo sapiens
  misc_feature 26: n = A,T,C or G
actacaggcatgaagtcatcaatatnaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagcccctgcttactagtgagaaagactg

SEQ ID NO: 53543 - DNA, 410 bp, Homo sapiens
agattaaaatgaaggtgacttaaacagcttaaagtttagtttaaaagttgtaggtgattaaaataatttgaagacgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagg

SEQ ID NO: 53544 - DNA, 130 bp, Homo sapiens
ttcttttaaaagtttaacaaaattgatgaaacgagctacacaaatcaagaaaaaaggagaatacttcaatttactaaaataaaaatgaaagagttgccattactaccaataaaaaaaaaaaaaaaaaaaa

SEQ ID NO: 53545 - DNA, 550 bp, Homo sapiens
aggatttctactggaggtggagaaacagaagaaactctgaagaaattgttacaaggaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagtaagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgattgtatgttatggatacttaaaatgcacgcaagccattatctctcc

SEQ ID NO: 53546 - DNA, 490 bp, Homo sapiens
  misc_feature 18, 42: n = A,T,C or G
atgatatccattttccgnaattgtgattacaatatgcaaagnagtcataaatatgccatttacaataaggaggaggcaaggcaaatgcctagatgtacaaatatatgtacaacagattttgctctttatttatttataatgtaattttatagaataattctgggatttgagaggatctaaaactatttttctgtataaatattatttgccaaaagtttgtttatatttcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcagggatataacagcacttcaccgaaatattctttcagccataccactggtaacatttctactaaatctttctgtaacacttaaaagaattccctcattcattac

SEQ ID NO: 53547 - DNA, 415 bp, Homo sapiens
cgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgctttggtttgtaaaaactcaccttaataaagacttaagatgttaaaaaaaaaaa

SEQ ID NO: 53548 - DNA, 500 bp, Homo sapiens
  misc_feature 282, 308, 356, 453, 469, 495: n = A,T,C or G
ttcggtcattatggccgggataaaaaaattgtgagcagcctatttgaaaggcatcatggaaatttcacagcacaataacacgggattttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagnccaccttaagaaattatttttgatgnccaagacatcactaaaatatttaagtttaaagtaataatggggggggntaatagattgggggggcttttactattttaaagacaactttcatacttcagatgttttttgagaagagggggaatgtgaggggagggggcagaacanggagggaggttggttngaatggaatcacattctttatattcnctcct

SEQ ID NO: 53549 - DNA, 410 bp, Homo sapiens
aagcatggatgggaagtgttgcattgagcataatttggaggtaaaatctccaacaccgtaactgagtggcctggggacctgatagaaagccttgctcaggactaaggcagagttcccagttatatcgcagatacaaagagaccaggaacacgcttgtaatcacagcacttagggaggctgaggcgggtggatgacctgaggtcaggagttcaagaccagcctagccaacatggtgaaacccccatctctactaaaaatacaaaaattagccaggcgtggtggcacatgcctgtaatcccagctactcaggaggctgaggtgggagaatcgcttgagcccgggaggagggggttgcagcgagctgagatcgtaccactgcactccagcctgggcaacagagtgagaccctt

SEQ ID NO: 53550 - DNA, 580 bp, Homo sapiens
  misc_feature 567: n = A,T,C or G
aaagaagaaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaattaatatttttttttttctgaatgaggaacatgagggaaattgtggagttagcctcctgtggtaaaggaattgaagaaaatataacaccttacaccctttttcatcttgacattaaaagttctggctaacttttggaatccattagagaaaaatccttgtcaccagattcattacaattcaaatcgaagagttgtgaactgttatcccattgaaaagaccgagccttgtttgtatgtttttggatacataaaatgcncgcaagccattat

SEQ ID NO: 53551 - DNA, 400 bp, Homo sapiens
  misc_feature 56: n = A,T,C or G
gaccctcgctctctgtctccaggcagttctctcgaatactttgaatgttgtgtaanagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcacccggtgggac

SEQ ID NO: 53552 - DNA, 346 bp, Homo sapiens
caaaatacatgaggaaacaagtttttataagactcagcagaagcaacaaggagtaaaattagacccactatatctggaaaaatatgaatcccctcaactacaagataagtaagctcaatatgttttaaaaagtaaagaagaacatcaaaagaataagtacaacagattatgaaatatggcaaggtagatttgaaaactgcccaaatagaaagtctaaaaatgaaatacataataatttaaattagaaacacaatgatggatgatgtagcaaattaggaatagctaaagagagatttgcttgaacttggaagatagatccaaaaaaaaaaaaaaaaaaaaaaaaaaa

SEQ ID NO: 53553 - DNA, 162 bp, Homo sapiens
  misc_feature 95: n = A,T,C or G
acagcctccccttgctcaagaaatgcaagtgcattacctcttaaattttaaaagctggtaaacttaataggaagtgcttctttatattgcaggtnctaaacttaaggagcccattaattacccccaaggagattgtagtcttaaaaaaaaaaaaaaaaaaaa

SEQ ID NO: 53554 - DNA, 314 bp, Homo sapiens
  misc_feature 4, 15, 26, 241, 256, 278: n = A,T,C or G
aagnaataaaaaagnaaatccatatncttaaagaaacagctttcaagtgcctttctgcagtttttcaggagcgcaagatagatttggaataggaataagctctagttcttaacaaccgacactcctacaagatttagaaagaagtttacaacataatctagtttacagaaaaatcttgtgctagaatactttttaaaaggtattttgaataccattaaaactgcttttttttttccagcangtatccaaccaactnggttctgcttcaataaatcttnggaaaacctcccaaaaaaaaaaaaaaaaaaaaaaaa

SEQ ID NO: 53555 - DNA, 490 bp, Homo sapiens
  misc_feature 343: n = A,T,C or G
taccgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtcttggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagnatgaagttccctatctacggaaaggcatgactggggaggcccacaaggactctcattgagttcttacttcggtttcagtcaagacaatgcttagttcagatactcaaaaatgtcttcactctgtcttaaattggacagttgaactta

SEQ ID NO: 53556 - DNA, 457 bp, Homo sapiens
  misc_feature 389: n = A,T,C or G
ctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggggggtgattattttttatactgnatgtgccaaagctttactactgtggaaagacaactgttttaataaaagatttacattccaaaaaaaaa

SEQ ID NO: 53557 - DNA, 500 bp, Homo sapiens
  misc_feature 12, 355: n = A,T,C or G
tggggtaacagnaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggnttctatgtctctgaaaaaggaactgttcagcaggctgatgaataagatctaagagttacctggctacagaaagaagatgccagatgacacttaagacctacttgtgatattttaaatgatgcaattaaaagacctattgatttgg

SEQ ID NO: 53558 - DNA, 400 bp, Homo sapiens
tggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtaagagttttagg

SEQ ID NO: 53559 - DNA, 450 bp, Homo sapiens
  misc_feature 410: n = A,T,C or G
ggaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaaggatgcatcttcatgggttatttgagggcaagnaaggctgcccaaagacacgagactttaacaagcttgaact

SEQ ID NO: 53560 - DNA, 260 bp, Homo sapiens
  misc_feature 59: n = A,T,C or G
ggtaagtatgtacctactaatataaaacttgctaatgtgattactggaaaataaaagcntcataaaatagtttttttaattcattttaattttttagtaaattttggaaagcaaaatagaatttggatattttttctgtgatattttagaaatattaaattatatagattagtaatttttctataatcaattctgtaatgtagagccaaatatctgtttttctcagctaggcaattataatgtgatgcctggatttctca

SEQ ID NO: 53561 - DNA, 400 bp, Homo sapiens
  misc_feature 112: n = A,T,C or G
aattcaagttggctgggggccggtagtgagatctagggctacttcaacaaaactttgctgcccttcctgctcctcttgtcttcttttctcctgataccttttgatgctctgnacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctgggtgtggctttg

SEQ ID NO: 53562 - DNA, 440 bp, Homo sapiens
  misc_feature 9: n = A,T,C or G
tatacaagnacaaaagttgtttcctggtatttataattcattgtagtgggggaagtagaaaattcaaaaaacaagtgaataacaagagtacatgtcagacaataagacatggtagattatttcagattgatagtcacggaagagctgtctgagaaggtgaaatttaaactgagacatgaagcgtgagaattatggtgctagggaaaaacttctgagatataagggaacaattaatgcaaaagtactaagacaggatggagcctggactattttaagaaaaaagaaatgtgttcctggcatcatgtgatcaagggaagggagtggtactaacgacgtaagtcagggagataatcagattatttctttataggccaaggtgaggtctcttggattttattcctgagttcagtaaaaagccattgagccatttttaataggga

SEQ ID NO: 53563 - DNA, 530 bp, Homo sapiens
ctttcttttttttaaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggccgagtgccggcctctgagcaagacagtgcgcttcaacgtgctcaaggtcaccaaggctgccggcaccaagaagcagttccagaagttctgaggctggacatcggcccgctcccca

SEQ ID NO: 53564 - DNA, 560 bp, Homo sapiens
  misc_feature 19: n = A,T,C or G
aatgtgcaaaaatacaagncattcttatacaacaataacagacaaacagagagccaaatcatgagtgaactcccattcacaattgcttcaaagagagtaaaatacctaggaatccaacttacaagagatgttaaggacctcttcaaggagaactgcaaaccactgctcaaggaaataaaagaggacacaaacaaatggaagaacattccatactcatggataggaagaatcaatatcgtggaaaatggccatacagcccaaggtaatttatagattcaatgctatccccatcaagctacccataactttcttcacagagttggaaaaaaactactttaaagttcatatggaaccaaaaagagcccgcattcccaagacaatcctaagccaaaagaacaaagctggaggcatcacgctacctgacttcaaactactacaaggctacagcaaccaaaacagcatgatactgttgccaaaacagagatatagaccaatgggaacagaacagagctctcagaaataacactacacatctacaaccatctgatctttgacaaacc

SEQ ID NO: 53565 - DNA, 500 bp, Homo sapiens
  misc_feature 69: n = A,T,C or G
agtacctttgtgttggatgaatttaagcgcaagtactccaatgaggacacactctctgtggcactgccntatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccaaacgctggttcgagagtacttttctggggagggggccttccagcatgtgggcaaaagccttcaatcagggcaagatcttcaagtgaacatctcttgccatcacctagctgcctgcacctgcccttc

SEQ ID NO: 53566 - DNA, 315 bp, Homo sapiens
  misc_feature 7, 313: n = A,T,C or G
cactgtnaacccaacacaggcatgctcataaggaaaggttaaaaaaagtaaaaggaactcggcaaatcttaccccgcctgtttaccaaaaacatcacctctagcatcaccagtattagaggcaccgcctgcacagtgacacatgtttaacggccgcggtaccctaaccgtgcaaaggtagcataatcacttgttccttaagtagggacctgtatgaatggctccacgagggttcagctgtctcttacttttaaccagtgaaattgacctgcccgtgaagaggcgggcatgacacagcaaaaaaaaaaaaaaanaa

SEQ ID NO: 53567 - DNA, 400 bp, Homo sapiens
  misc_feature 348: n = A,T,C or G
ataataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtagttgcctagaaatatctttctcttacctgttatttatcaatttttcccagtatttttatacggaaaaaattgtatttgaaaacacttagtatgcagttgataagaggaatttggtataattatgggggggtgattattttttatactgnatgtgccaaagctttactactgtggaaagacaactgttttaataaaagattt

SEQ ID NO: 53568 - DNA, 500 bp, Homo sapiens
  misc_feature 448: n = A,T,C or G
atgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatggttgaagacatctaccagtttctccaaatgccttttttaaaactcatcacagaagattggngaaaatgctgagtatgacactttttcttcttacatgcatgtcagctacataa

SEQ ID NO: 53569 - DNA, 440 bp, Homo sapiens
  misc_feature 268, 378, 380, 403: n = A,T,C or G
cagttaggcctgtatgtgtgtacctgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgnctaagtgctaacactgtttcagtgaaaatatctagccataagattaaaaaaaatattatttattttgcaatgcttaagcctgcagatacgtaatgtgaccactgttttgngnttgacaatattgctttatacagntcttgtattttgaaaaggaattgatccttttaaagaa

SEQ ID NO: 53570 - DNA, 310 bp, Homo sapiens
  misc_feature 248, 275: n = A,T,C or G
tagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttttngctgttccaccaaatacaaattcaaangccttttggttttaattttttttacccaattccaa

SEQ ID NO: 53571 - DNA, 500 bp, Homo sapiens
  misc_feature 385, 443, 446: n = A,T,C or G
tgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagtccacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggnggagaacaagaaagctcagctggtggggattgcacacgacgtggatcccatcgagctnggntgtcttcttgcctgccctgtgtcgtaaaatgggggtccccttactggcattatc

SEQ ID NO: 53572 - DNA, 530 bp, Homo sapiens
atgagagcatttattattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatggg

SEQ ID NO: 53573 - DNA, 450 bp, Homo sapiens
  misc_feature 443: n = A,T,C or G
atatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaaggcaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatacctgtaagaatataagtattaaagngcgttca

SEQ ID NO: 53574 - DNA, 313 bp, Homo sapiens
  misc_feature 2: n = A,T,C or G
tntataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcaaagcatcaaattaaacagacagaaaccgaaagctctatataaatgctcagagttctttatgtatttcttattggcattcaacatatgtaaaatcagaaaacagggaaattttcattaaaaatattggtttgaaataaaaaaaaaaaaa

SEQ ID NO: 53575 - DNA, 500 bp, Homo sapiens
atggaaggaagcaagaaaatgtgacccaatcaagagaaaacaaaacccaataaagaatatccagataattgagttagcaaatgagaaccttaaaataactgattaacaagtttaagatgataaaagaaaagagaacttcagttggaatctgcaaaaatggtgtaaaatgaatattctacaactggaaaatatctgaaattaagaacacaatagataggtttagctattcaggcagagcaggaaacagtattaggacctgaaagatcggttaaaaatatccaaactgatgcacaaagagaaaaaggaatgtgaaatatagataaaaggtttgagacattttgagacatgttaaactgtgctaacacattaggaaaaagagaaagtgagacaaaaaggaagaggggaaggaggaggagggagaagagaaataggagccagaagaaatatttaaaatgatacttactcagaatttttccaaaactgataaagtacatttagcc

SEQ ID NO: 53576 - DNA, 370 bp, Homo sapiens
  misc_feature 11, 330: n = A,T,C or G
atctaaaactntgaataagttctgtggtaaaatcttaaactatggaaaattacaaaaatgaatttttcttccctgaaatcagagcttacatgtgtgttttttttataacattttcagataaatgtattcaacatgtaatacagtattttcacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtaggattatttgnatattttgtaaaaactggtaggtctttatatttttaaagg

SEQ ID NO: 53577 - DNA, 320 bp, Homo sapiens
  misc_feature 115, 133, 205, 252, 268, 292: n = A,T,C or G
gataaacctttaaaaaaaggaactaataccaattatactcaaactattccaaaaaattgaagagggcagaatattttcaatctcattctatgaagacagcattatcctaataccnaaaccagaaaaggacacnactaaagaagtaaactacagagcagtatcccagatgaacacagatgcagaaatcctcaacaaaatactagcnaactgaactcaacagcacattaaaaagatcactcaccatgattaagnggggattcaggatggntcaacatatgccaattaataagcntgatatatcacatcaacagaataaaggg

SEQ ID NO: 53578 - DNA, 410 bp, Homo sapiens
caagtatgtccgtggttcagaccctgtattaaagcttttggacgacaatgggaacgttgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatcttaaggagttggcaagcttaacaaaacccattttttataaatgtccatcctcctgcatttgttgataccactaacaaaatgctttgtaacagacttgcggttaattatgcaat

SEQ ID NO: 53579 - DNA, 137 bp, Homo sapiens
  misc_feature 24, 33, 38, 76: n = A,T,C or G
aagtaaaatgccctttttctcaantaatctaantccantagttttaaaaacatcaaagagagctaaaatctatatnaataaaaacagcagtcccatgcaaccctgctgtacccagttaaaaaaaaaaaaaaaaaaaa

SEQ ID NO: 53580 - DNA, 320 bp, Homo sapiens
aacattgaatgagataaatttccgatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgt

SEQ ID NO: 53581 - DNA, 405 bp, Homo sapiens
  misc_feature 36, 380: n = A,T,C or G
tctttgctttgttccaatacaaaggtgctaattaanagtatttcagatacttgaagaaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtccccttcttcagattcagcatttgttctttgccagtctcattttcatcttcttccatggttccacagaagctttgtttcttgggcaagcagaaaaattaaattgtacctattttgtatatgtggaggatgtttaaataaaattgtgaaaaaaatgaaataaagcatgttttgggntttccaaaaaaaaaaaaaaaaaaaa

SEQ ID NO: 53582 - DNA, 420 bp, Homo sapiens
  misc_feature 31: n = A,T,C or G
cacccctgggagtttcctgagggttttctcntaaatgagggctgcacacttgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaatttgtatttgaaaacacttagtatggcag

SEQ ID NO: 53583 - DNA, 229 bp, Homo sapiens
  misc_feature 5, 6: n = A,T,C or G
aagannagtctggccagcatggtgaagccttgtctctactaaaaatacaaaaactagctgggcatggtgttgcacgcctctaatcccagctatttcaggaggctgatgcaggagaatcactcgaatccaggaggcagaggctgcaatgagccgagattgcaccactgcaccctagcctgggtgacagagcaggactccatctcaaaaaaaaaaaaaaaaaaaaaaaaaa

SEQ ID NO: 53584 - DNA, 300 bp, Homo sapiens
tatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggccta

SEQ ID NO: 53585 - DNA, 410 bp, Homo sapiens
actttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcacttgtatctatgaaatacctcataacttacgtttacatgttttcctaactttttgtatttttcttgtatagccacctagagaattcttcataggattaagaactacagttttcaccacttaacataagtaaaacaaagtccttcataatttaaccattagcatcttttggccaaaccaaaataaagaaaagcatctt

SEQ ID NO: 53586 - DNA, 280 bp, Homo sapiens
  misc_feature 17: n = A,T,C or G
ttatggccggggaaganaaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtacaaaaaataaaaaaaaaaaaaaaaaa

SEQ ID NO: 53587 - DNA, 300 bp, Homo sapiens
  misc_feature 33, 38, 201, 208, 209: n = A,T,C or G
ctcactgtcttggtaccaagaaaagtgtttccntcacntgccttggtagaattatttcagtgttattatttttgtgatttcgtatgtctacacaaaaatgaattagtttaatttatattgtgatacagttgtttgagaaatatttttaatttctgtttcaactttatttctccaagtgtataatataaaaattacttctgntattggnnctctaccaataggggaaaaaattaaaacattagatccattgggaaagagatgatgtaataaataattaaagattagtaataatatttatcc

SEQ ID NO: 53588 - DNA, 530 bp, Homo sapiens
tcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatattttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccctgtggttttgtactataatgccaacagggcattttcagaagatggacacaaagaagaaggaggaaccagttgaagcttctcaaggagaaatatggcatcaacacagatccaccaaaataaatgttttctacatttttcattttggactaaatcccacgaatgac

SEQ ID NO: 53589 - DNA, 450 bp, Homo sapiens
  misc_feature 22, 54, 70, 92, 96, 373, 427, 447: n = A,T,C or G
cggtgccgcttgcaggaggctnagcgagcgtccctggtgggtctgttcgaaganaccaacctgtgtgccntccacgcttaagagagtcaccntcantgcccaaagacatccagttggcttcgccggatacggggaagagagggcttaagtgaaggcagtttttatgggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtggcactgttgctcaaggagtgacaagttgctaatatgcagaagggattggggngataccttcttgcttctcatgatgcatgtttcttgtatgttaatgacctttggntggggtagcttatttaaggncta

SEQ ID NO: 53590 - DNA, 220 bp, Homo sapiens
  misc_feature 11: n = A,T,C or G
aaggaagagantttatgtggcttctcctttttaaatcccctcagaaggtgtgactagtctctttatcagcacacacttaaaaaatttttaatattgtctattaaaaataggacaaacttggagagtatggacaactttgatattgcttggcacagatggtattaaaaaaaccacactcctatgacaaaaaaaaaaaaaaaaaaaaaaaaaaaaaaaaaaa

SEQ ID NO: 53591 - DNA, 295 bp, Homo sapiens
  misc_feature 91: n = A,T,C or G
ctctaaggcctaccaccttcgaagtcgacctgtggcaaatgtggctaccctgccaagcgcaagagaaagtataactggagtgccaaggctnaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttcttggttttaaaaaaaaaaaaaaaaaaaaaaaaaaaa

SEQ ID NO: 53592 - DNA, 400 bp, Homo sapiens
  misc_feature 7: n = A,T,C or G
acaaganggcgccgaaagcgaagaaggaagctcctgcccctcctaaagctgaagccaaagcgaaggctttaaaggccaagatggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagattagaagacaacaacacacttgtgttcatttgggggatgttaaagccaacaggcaccagattaaacaggctgtgaagaagctgtatgacatttgatgtggccaaggtcaacaccctgattcggcctg

SEQ ID NO: 53593 - DNA, 380 bp, Homo sapiens
  misc_feature 53, 95, 108, 206, 209, 278, 281, 308, 321: n = A,T,C or G
aaggaaaggaagaccttttcaaccctggtgctggagcagattacgttgtatantgtttgaagttttctactaacaaatggtcaaaaaaaaaaatntagcccagacttnttcaaaaattaagtatttctgcagaacagaaagtttctggttgaaactcatgaccctgtagatgaaggctcacagcttgagaaacactaatctaaggngtncaactaggaggcaaggcatataattaggtaatgacatgttcaacttggtaatgctaagttagtttccanagnggctgcatgactttatataccttccanaaactgattaggnggataggggctgacctagctgacttcaagacttattttaaagctttagtaatttaagac

SEQ ID NO: 53594 - DNA, 450 bp, Homo sapiens
  misc_feature 18, 85, 119: n = A,T,C or G
ctctggccctggaggctnctcccagcgtacctccaaagacgtcaggtttacttcacgtcctccagcagagaatggaaagtcaaantttcccgaattgctactgtgtcttggggtttcantccctccgacatttggaagttgactttactgaaagaatggagagagaaattggaaaaaagtgggagcattcagacttgtctttcagcaaggactggtctttctatctctttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgt

SEQ ID NO: 53595 - DNA, 330 bp, Homo sapiens
  misc_feature 4, 17, 33, 37, 44, 50, 52, 73, 85, 86, 87, 90, 95, 125, 128,135, 148, 149, 159, 161, 163, 165, 169, 176, 182, 205, 243,291: n = A,T,C or G
accnttcccggcggggnccgcggccccaccggncggngatagcnctcgcncncacactactctactgcgacantgccatatattnnngantatcnaactgcatgctagggaataatgtgtttatnccntgcgacngattacgatattnncatccttatntntntntggntacaatntatatngagatatatctgcacattctggnaatctaaaatccttaaaaatactctaatagccttgagngaccaactttttttttaaagcacagatgtaattgtctaatgttctgangggaacgtaacacttatttttatataaaaagagactgag

SEQ ID NO: 53596 - DNA, 150 bp, Homo sapiens
  misc_feature 6, 56: n = A,T,C or G
ataacnacatatgtaaatacacacacacacacacacacacacacacacacacacanatatactcttattcccagaacttccccaattgtgatctatatagatgtgtgcttatgcactgatatgaacttttaaaatacattttctttgaag

SEQ ID NO: 53597 - DNA, 423 bp, Homo sapiens
  misc_feature 27: n = A,T,C or G
tttaaaggcttcgttttgtaactcccntgtaaaaagggttagagtaaatctcttgtgtaattttacatggcatttattattgagaaatggatttggcaaggcaacagttaggtcttacttcagacttcattggtcttgaaatagattcatggtaacagtaaatatttttcataatatttgaacttttgaagttgcattttgcctgacttacaatttgtgtcaaaaattttaatcagttcagtaatggcacggctaagcttgcagtactagtttcctgtatccttttaaagcctaaaatgcggccgggcgccggtggctcacgcctgtaatcccagcactttgggaggccaaggtgggcggatcaccttgacgtcaggagttcaagaccagcctggccaacatggtgaaactccgtctctaccc

SEQ ID NO: 53598 - DNA, 336 bp, Homo sapiens
  misc_feature 58: n = A,T,C or G
agcagtttcctaaagttgaatctcaactgaataagctaaatcctctcctcactgatanttcttgctgatgtgaagacaaaaagaaaaactttggcaaataataaattacctcaaatggaaagagaattctctgcatattttttaaaagatgaagattatctgaaagatattgtggagaatttagaaactcaatcaaagattaaggctgttagtcttgaagattgaaaattactgaaaactgaatctttattacgtgtcctcttttatttatttagaagactgtgtataataaacactactaaatttccaaaaaaaaaaaaaaaaaaaaaaaaaaaa

SEQ ID NO: 53599 - DNA, 360 bp, Homo sapiens
  misc_feature 276: n = A,T,C or G
ctgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgngatatatatatatatatataaatgtataaatatatattttatttttttttaaaacccttggagcttctgggtcctatcagttcc

SEQ ID NO: 53600 - DNA, 500 bp, Homo sapiens
  misc_feature 38: n = A,T,C or G
aaggtatttctgtaatatggaaactggggaaacctgcntaagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaaagaaggccctgaagctgatggggtcaaatgaaggtggattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacatttggtggtcctgatcaagaatt

SEQ ID NO: 53601 - DNA, 100 bp, Homo sapiens
  misc_feature 17: n = A,T,C or G
ttcaggccgtctgcttntacatatactatcgagaatggtgctgtgcactcataacaccgttgcttggtagacgcttttgaacccttcagcgctgaaagta

SEQ ID NO: 53602 - DNA, 280 bp, Homo sapiens
  misc_feature 106: n = A,T,C or G
cttttgggaggctgaggcgggtggatcacgaaggtcaggagatggagaccctcctggcttaacacggtgaaaaccccgtctcttacttaaaaaaataaataaaaantaaattagccgggcgtgatggcaggtgcctgtagtcccagctactcgggaggctgaggcaggagaatggcatgaacccaggaggcggaggttgagtgagtgagatcacgccattgcactccagcccgggcgacaaagtgagactccatctcaaaaaaaaaaaaaaaaaaaaaaa

SEQ ID NO: 53603 - DNA, 419 bp, Homo sapiens
  misc_feature 63: n = A,T,C or G
acttttgcccttccctcttccctgaggaacaaagcacgtatctttagtctctttgatatttanttctgagaccaagggcttgcttgacctgatgattttccttcagctctctgaaggtgctttttccacaatccaagtgattctgatacacactaaagttgagaatcactgcactagatcactttgtgttttctgattttcaaggttgatacatagctttaatacagctcttctgttgacagttattactttaattttgcatttgttccttgtaagaatggctggaaacctgtgtgttgacatttgaggatgggtatgcaaggaaaaaatatacttctgtttacttactctgactttgaaatagtgttatttttctatatctgaaataaatgcttctaccaaaaaaaaaaaaaaaaaaa

SEQ ID NO: 53604 - DNA, 440 bp, Homo sapiens
aactcggtggtggccctgcgcagaccagacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccgcgcctgcctttcccatctgtctatctatctggctggagggaaggaaagaacttgcatgttggtgaagga

SEQ ID NO: 53605 - DNA, 220 bp, Homo sapiens
  misc_feature 6, 30, 36, 41, 43, 55, 89, 116, 138: n = A,T,C or G
ccgcgnacttttggttgcggaaatcgcgtnaccganccgtnantttcggaatccnaggaaggtgcttgaaacccccccaaggcactttnccggggaaaggaaaaaatcgcttgctnacaaggttgggcgggcaaaaanccgtgattcgagccttttggtgaaaatgccccaaaagccccgataccctgaagaaaaaaaaaaaaaaaaaaaaaaaaaaaaa

SEQ ID NO: 53606 - DNA, 134 bp, Homo sapiens
  misc_feature 22: n = A,T,C or G
aatttaacaaactaggaaagangaaaagggaaattgtggccaaaaacttttgggaaaaggaggttctttaaaaatcagtgtttccccttttgtgcactttacaaaaaaaaaaaaaaaaaaaaaaaaaaaaaaaa

SEQ ID NO: 53607 - DNA, 370 bp, Homo sapiens
  misc_feature 59, 79, 90: n = A,T,C or G
acaaagaaacaaaattagttcgtctaaggggactggctggccacactactttgttcctntgcccctactgctttctacnttcttgttctntcttactgaaattactgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagag

SEQ ID NO: 53608 - DNA, 410 bp, Homo sapiens
  misc_feature 4, 17, 33, 39, 46, 89, 96, 97, 124, 260, 304: n = A,T,C or G
agancttcgcttcgtanctcgtgcgccttcgcnttcgcnttttccntccgcaacccctgtcttgacaaacccgatattggcttgagacncgagaanntttcgataaagtcgaaacttgaaagangacagagacgcaagagaaaaaatccacttgcctttccaaagaaacgattgaacaggagaagcaagcaggcgaaatcgtaatggaggcgtgcgccgccaatatgcactgtacatttccacaagcattgccttcttanttttactttctttttagctgtttaacttttgtaagatgcaaagnaggttggatcaagtttaaatgactgtgctgcccctttcacatcaaagaactactgacaacgaaggccgcgccctgcctttcccatctgtctatctatctggctgga

SEQ ID NO: 53609 - DNA, 280 bp, Homo sapiens
  misc_feature 2: n = A,T,C or G
ancccctaaggagggctgtgtggagaagactgggggctggctgaggaaaaatgtgctggtggtagctgcagcagccctttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccaaaaaaaaaaaaaaaaaaaaaaaaaaaaaa

SEQ ID NO: 53610 - DNA, 510 bp, Homo sapiens
  misc_feature 10, 20, 56, 62, 70: n = A,T,C or G
cagaaagagnggcagaggangctgcagctgattcagagtaggctacaagaagagcnttcacnttcaagangtgatctttaaaagtgcttttaaaagtacattcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccattggagtc

SEQ ID NO: 53611 - DNA, 340 bp, Homo sapiens
  misc_feature 12, 13, 45, 49, 80: n = A,T,C or G
cagctttgggcnnttcttgcttagacagtcagcatttgtcttccntccnttaactgagtcctcctctttaagtccaactnaatgcagtcgatacaatgcgtagatagaagaaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgtaaaaaaaaaaaaaaaaaaaaaaaaaaaaa

SEQ ID NO: 53612 - DNA, 300 bp, Homo sapiens
  misc_feature 58, 61, 70, 84, 128: n = A,T,C or G
agcagcttggaactcgcccagtgaaacttgaaacttgccttctttcttgtggaagaanganttctaagancttacaaagcttantcccactttcctccctggtgaaaacatcttcgagggctttcctntttttgcatacccttgtatttaaagctcttttcttccacttgctgaattttttggaaattgacaaacaaatctttaaaaaattaatcccaggctatacttcttttgagctaaaaatctgggttattttcttttctctttcagggtctttccttctctctttctttttctttt

SEQ ID NO: 53613 - DNA, 505 bp, Homo sapiens
aatttttagcttagggcctggtggctaggtcggttctctcctttccgtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattgggagattacaatggattaaatcaataaataactgaaactcaaaaaaaaaaa

SEQ ID NO: 53614 - DNA, 390 bp, Homo sapiens
  misc_feature 15: n = A,T,C or G
tttaacactttgttntcaagcaccttttaaaaagaactgtactgtaaatggaatgcttgacttagcaaaatttgtgctctttcctttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttaattattacctgatttaaaaatctctg

SEQ ID NO: 53615 - DNA, 500 bp, Homo sapiens
  misc_feature 12: n = A,T,C or G
aaaaacctagtnctttgaaagcagtttgtgctactacttttcccccaaccctccaataaatcttaaatttaaaacctacaatgtagtgtctcccctttaggttcactcaaactgatgaaagtaatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataaccttgcagttgaacttgattctgttcactgtcacacttctaattattcatttcttcatttatggacatatataatttatttcttggctagcttgcttacatggttaaatttttctttctacatctgcaatgtatcttttttatttttatt

SEQ ID NO: 53616 - DNA, 168 bp, Homo sapiens
  misc_feature 14, 48, 54, 60, 72, 86, 109, 110, 133: n = A,T,C or G
cccgggtgggtgancgcttggctttcttcaaacggccgaaagttgccntctttnaggaantctctttggaanttgggaagcacgantgacttcttgaagtttgaagctnnttaaaagtactttctttacacantttgcaaaaaaggataaaaaaaaaaaaaaaaaaaa

SEQ ID NO: 53617 - DNA, 169 bp, Homo sapiens
  misc_feature 35, 50, 79, 80: n = A,T,C or G
acctcggcttcgtgcgtcgatgaagaacgcagctnagcttgcgaagaatnaatgtgaaattgcaggacaacaattgatnntcgacactttcgaacgcactttgcggccccgggttcctcccggggctacgcctgtctgagcgtcgcttacaaaaaaaaaaaaaaaaaaa

SEQ ID NO: 53618 - DNA, 450 bp, Homo sapiens
  misc_feature 3, 22, 95, 114: n = A,T,C or G
aanctcacagtcttctccagcntcaccctgggagtttccctgagggttttctccaaaatgagggctgcacacttgcctgttctgcttcgaagtanttcaactaccgctcagtanttttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgata

SEQ ID NO: 53619 - DNA, 310 bp, Homo sapiens
aaggcggtcaccttctccttactatagtcgtggaggatacagatcacgttccagatctcgatcatactcacctcgtcgctattaaagcatggagactttctgaaacctgccctagagctgggatattgtttgtgggcaatattttttattgtctcttgtttaaaaagtgaatagtgcctagtgaagttaggtgacttttacaccttttacgatgactacttttggtggagttgaaatgctgttttcattctgcatttgtgtagtttggtgctttgttccaagttaagtgttttcagaaaagtatgttttg

SEQ ID NO: 53620 - DNA, 430 bp, Homo sapiens
  misc_feature 381: n = A,T,C or G
agtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattattggagtgcttccatccctctccaccccttccccccaaaaggntttctttgcaagtgcttttggaactaagagctagtatcttggattaact

SEQ ID NO: 53621 - DNA, 320 bp, Homo sapiens
  misc_feature 3, 197: n = A,T,C or G
agnatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataattngaaataaaactaaggaaatggaatcttaaaagtctatgacagtgtaactctacagtctcaaaatgacctgataaattgataagacaaagatgagattattgggggctgttcatattatgattc

SEQ ID NO: 53622 - DNA, 267 bp, Homo sapiens
cattatttttgctagcaaagtataaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttggcaaaaaaaaaaaaaaaaaaaaa

SEQ ID NO: 53623 - DNA, 290 bp, Homo sapiens
agatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgcaaatagtttaatctcttctattttgttgtcgttgcttgtttgaagaaaatcatgtcattccaagttgacatttttttttcattttaattaaaatttgaaattctgaacaccgaaaaaaaaaaaaaaaaa

SEQ ID NO: 53624 - DNA, 448 bp, Homo sapiens
atccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatattgacaaaaaaaaaaa

SEQ ID NO: 53625 - DNA, 300 bp, Homo sapiens
  misc_feature 6, 49, 108, 110, 139, 158, 198, 204, 249, 259: n = A,T,C or G
catggnaattgacttatgccaattgattaaaacaaacatcctgtgtgtnctgtgaaatacatacaactttaaaatgaaaaactcataattttatgcatgaattttggngntcatgtggcttggaaatatgtgccttaantggaattaagattcaaagnatttgctaatcttcaaccaactttgaattgttactggtgnggaagngagcatattgttttagaatttctgaatctacatggatatacaagntatatatttnttctgctacagaaagctttgttttccaagagaatttaatgg

SEQ ID NO: 53626 - DNA, 392 bp, Homo sapiens
caaccaagtagcaaatgttttgaaatgatatgacccaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatttcaaaaaaaaa

SEQ ID NO: 53627 - DNA, 370 bp, Homo sapiens
agttacaggaaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttaccggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctag

SEQ ID NO: 53628 - DNA, 280 bp, Homo sapiens
tatgtgggatgggagatactgatgcagccatctttggaaacattctacttagctaattttatgctaggctttaggtcaagaaggagagagagagctgacatgctgtggtacacacttatagtcccagcgacttggagagctgaggcaggaggattgcttgatcccaggagtttgaggtagtgtgcgatgatcgttcttgtgaatagccactagccactgaactccagcttgggcaacattgagacaccctgtctcttaattcaaaaaaaaaaaaaaaaaa

SEQ ID NO: 53629 - DNA, 100 bp, Homo sapiens
  misc_feature 20, 47, 73: n = A,T,C or G
tcccgtgaccttcctgcttncgagaccatggcgctttgcccagggcntgtactcccctgagaggccttctgcntacaaagatctatgactgggttccaaa

SEQ ID NO: 53630 - DNA, 245 bp, Homo sapiens
catcatacggtgccaaggaccacgcatccattccagatgaacgtggcccgaggttgacaaggtcacaggcaggtttaatggccagtttaaaacttatgctatctgcggggccattcgtaggatgggtgagtcaggatgattccattctccgattggccaaggcccgatggcatcgtctcaaagaacttttgactggagagaatcacagatgtggaatatttgtcataaataaataatgaaaacct

SEQ ID NO: 53631 - DNA, 325 bp, Homo sapiens
  misc_feature 12, 13: n = A,T,C or G
atcgagtaaagnnctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttcggactcagcccacctgcacccaggtgaaataaacagccacgttgctcacaaaaaaaaaaaaaaaaaaaaa

SEQ ID NO: 53632 - DNA, 106 bp, Homo sapiens
cagaggccatctgatgcggagccttcagcgtagtgttaagctaggcttcgcaatctgaccacttaactctcccagcaaagaaaagaaaggcttaaatactaaaaaa

SEQ ID NO: 53633 - DNA, 153 bp, Homo sapiens
ctttcaaggtacggttaataagaaaaacaaaagaaaactttttcccaccttcttagaatatagttcagtttaaaaggctcctcttaaaccttcctggatagaacataggaacataattggaatattgttcttttgtattatagttactctact

SEQ ID NO: 53634 - DNA, 400 bp, Homo sapiens
gaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgt

SEQ ID NO: 53635 - DNA, 215 bp, Homo sapiens
atcttagttcaactttaaatttgcccacaaaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaaaaaaaaaaaaaaaaaa

SEQ ID NO: 53636 - DNA, 260 bp, Homo sapiens
tatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgcggggaaaagtagtctcaaataaaagctaatttcttcaaaaaaaaaaaaaaa

SEQ ID NO: 53637 - DNA, 253 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaaaaaaaaaaaaaaaaaaaaaa

SEQ ID NO: 53638 - DNA, 360 bp, Homo sapiens
tgtggtatatgacaaaacgtatgtatttaaggtctcttcagtgaaagtacggaataccaaagttgttgatatgttgggcgtctttttctttaagtttgttacttacctaattagttttacttaggaaaccagttaactggcaatctgttgttatcagctagaccaaaagaaaacctcaagaaaatgcaggtttctggtaaatttattagtgtagttgacattttcccacctgcttatcagaaacaaccatgtggacactgtttgaaaatagaaagttataaaaatacttaggaaaaaattgtaaacattagataattgaatgaactgtcccagaactaaaaaaaaaaaaaaaaaaaaaaa

SEQ ID NO: 53639 - DNA, 550 bp, Homo sapiens
agagtaaatcatctttccatccagagaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacg

SEQ ID NO: 53640 - DNA, 450 bp, Homo sapiens
tagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaa

SEQ ID NO: 53641 - DNA, 434 bp, Homo sapiens
tccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaa

SEQ ID NO: 53642 - DNA, 460 bp, Homo sapiens
ctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgtttttgtggaccact

SEQ ID NO: 53643 - DNA, 170 bp, Homo sapiens
tacggcaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaaaaaaaaaa

SEQ ID NO: 53644 - DNA, 390 bp, Homo sapiens
  misc_feature 264, 290, 367, 379: n = A,T,C or G
attttaattctgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgntttcttttttctgtttttttctttgntaattcatttaaactcattgaaaacatagtatacattactaaaaggtaaattatgggaatcactgaaatatatttgnagattaaattgntggaacattgg

SEQ ID NO: 53645 - DNA, 190 bp, Homo sapiens
  misc_feature 20, 31, 59, 77, 109, 112, 122: n = A,T,C or G
tattttttcttaagtatacngtgcctgtacngaaatgtattgttgagtattactttgtncaggttgatcactttttntagagtgcagaaagaacaaacttgctttttgnggnttttaaaggnatataaaacacatgaaggactgtataattgatgccaacacaacgcgttgttctttagtcacaccgacg

SEQ ID NO: 53646 - DNA, 300 bp, Homo sapiens
  misc_feature 86, 182, 212, 232, 234, 236, 241, 242, 271, 287, 299: n = A,T,C or G
agaataaaatgctccctgccccacacagccataacatcctatggccctgaaaatagttctgccaagctgcgtgcggtggacacttnacggctggcacaggagagatcacaaggccttgctcaatttcatcagaaagtggaaagcgactcagcagattgtgaagcacaagtggaagctgatanttggtgtttcttacaaatcaacggcttgtntccacacatcaaggtgaganantnaatgnngaagaggagaaataacccacacaaccacntacaactaggaaatgntagatggatctna

SEQ ID NO: 53647 - DNA, 400 bp, Homo sapiens
atggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcaggg

SEQ ID NO: 53648 - DNA, 510 bp, Homo sapiens
  misc_feature 505: n = A,T,C or G
atggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgnccctc

SEQ ID NO: 53649 - DNA, 350 bp, Homo sapiens
  misc_feature 79, 83, 92, 302: n = A,T,C or G
atctcatagctatctttttttaaagaaattaagttcttgaaaatttagccaaatcccgttttatgggaatgctctttanaatncattttgtncagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctgtttataataacaagnatatgtgaaatttcttattgtaagactactaccggcttactgttgaat

SEQ ID NO: 53650 - DNA, 400 bp, Homo sapiens
atacaggtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttt

SEQ ID NO: 53651 - DNA, 156 bp, Homo sapiens
ttcctaacggaaagaactgattgatgtttgaggtgatggataccccagttaccctgatttgattgttacacattgtgtgcttttatcaaaatatcacatgtacttcataaaaatgtacaactattatgtattcataataattaaaaaaaaaaaaaa

SEQ ID NO: 53652 - DNA, 225 bp, Homo sapiens
aagtacagtgttgtacattgcagggtacttaaaaatgtagagtgccaggcatggtggtgcatgcctatagtcccagctccttggaaggctggggccgggaggattgcttgaggccaggagttcaaggtggcaagtgcgctatgcttgtgcctacaaatagccactgcactccagcctggacaacatagcaagaccctgtctcataaaaaaaaaaaaaaaaaaaaa

SEQ ID NO: 53653 - DNA, 520 bp, Homo sapiens
  misc_feature 428: n = A,T,C or G
agtggagaatactgggttgaccctaaccaaggatgcaaattggatgttatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaagggtgaattcaaggctgaaggaaatagcaaattcacctacacagttctggaggatnggttgcacgaaacacactggggaatggagcaaaacagtctttgaatatcgaacacgcaaggctgtgagactacctattgtagatattgcacc

SEQ ID NO: 53654 - DNA, 234 bp, Homo sapiens
aagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatatatttaaaaaaaaaaaaaaaaaaaaaa

SEQ ID NO: 53655 - DNA, 366 bp, Homo sapiens
ctttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactggaagcagtccctgccccccggtttgggaggtgaaggaactgaaatgaaccagacacactgattggaactgtatttatgttaaaatact

SEQ ID NO: 53656 - DNA, 430 bp, Homo sapiens
  misc_feature 364: n = A,T,C or G
ttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagatatgaagtattgnaccagagtattaaaagatatgtaatattttaattggataaaatctatcctttaaaaggaataccgt

SEQ ID NO: 53657 - DNA, 340 bp, Homo sapiens
tcctacaaccgtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgct

SEQ ID NO: 53658 - DNA, 340 bp, Homo sapiens
  misc_feature 300: n = A,T,C or G
tacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtctacctgagagagaacaaaaagagagacttttttgtattggaagtaatctgattaattttttattttcttcaaggagagatacttgaaaggnatgtgtttgtccatctgttggatccaaacatttctatatt

SEQ ID NO: 53659 - DNA, 270 bp, Homo sapiens
aaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtcgcaaaaaaaaaaaaaaaaaaa

SEQ ID NO: 53660 - DNA, 490 bp, Homo sapiens
  misc_feature 24: n = A,T,C or G
cacgctttatttagctatctcagnacatataagaaaaaaaattactgtttttcaaggatgtttaagaggatgcttataagccactcttaagaagtctttctaatggataacaaccataactagtaacggaagttctgtcttctaagataattccccatttatatagttcaaaagaacaactctattttgaggacagtgtttttttacatagtaatctcattttatacccaaatattatccccattttcctatttcatattttcacacataacgtggttgggtctcatctgatgccacttcaattcacttataaaatagaatgattctactgccctttcatacatcatggagctttgtctcttctctccttccaaattatatagaagaaggctacaaaaatcttctgccctagaagtaaagttagcaatgttgaattgattgggataaagggtaatggaacattcaaatgtcaatatatttgggagggagt

SEQ ID NO: 53661 - DNA, 350 bp, Homo sapiens
  misc_feature 6: n = A,T,C or G
agagangaactgaggtccttgttttgttttgttcataatacaaaggtgctaattaatagtatttcagatacttgaagaatgttgatggtgctagaagaatttgagaagaaatactcctgtattgagttgtatcgtgtggtgtatttttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgacctattttgtatatgtgaa

SEQ ID NO: 53662 - DNA, 160 bp, Homo sapiens
  misc_feature 49, 86, 124, 145: n = A,T,C or G
cccagaagttgctgctgacgcttctgggtgaagaatggaagggttatgnggtccgaatcagtggtgggaacgacaaacaaggtttncccatgaagcagggtgtcttgacccatggccgtgtccncctgctactgagtaaggggcnttccctgttacagac

SEQ ID NO: 53663 - DNA, 140 bp, Homo sapiens
  misc_feature 24, 74, 82: n = A,T,C or G
agaagtggcaagagcggccaactnttcttgctctggatcttaaaggaaaagctttcaacttttccttgttaagnatggtgtnaactatgtgtaatggactatatggccttctgcttgttgaagcacattccttctatact

SEQ ID NO: 53664 - DNA, 400 bp, Homo sapiens
  misc_feature 21: n = A,T,C or G
ctttcccggcgggtgacaatntcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctaaaaaaaatagtcaatagtgctcagactggtagcttcaaacagctcacagttaaggaagctgtgctgaatggttttggtggccactgaggtgttgatgtggttttatgtcggagagattataggcaagcggggcatcattggctatgatgtttgaagaccaatctttaacatctgatta

SEQ ID NO: 53665 - DNA, 400 bp, Homo sapiens
  misc_feature 290, 309, 385: n = A,T,C or G
atatagtctacatactagtcctatgtcagatatgtaggttgaaaatattttcttccttctgtgggttgactttttagttcttctatgagaggcttttacagtgcaaaaatttttaagttcaaagtccagttatcaattttatttctatgaattctgcttttggtgtcaagtctaagaactctttggctaatactggttcctgaagattttctcctatgtttcgaaaagtgttatagttttatattttatacttaaatccatgatatttttacttaatttttgtataaggnttgagatttaggtcaaggntaattattgtacttacggatgtctgattgtttcaaaaccatttcttgaaaaggctatctttcctctgttaaattgnttttgcacttttggt

SEQ ID NO: 53666 - DNA, 359 bp, Homo sapiens
aggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcattgttgtaaacatttctttcaataaactaaagaaaaattaaaaaaaaaaaa

SEQ ID NO: 53667 - DNA, 410 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaa

SEQ ID NO: 53668 - DNA, 446 bp, Homo sapiens
  misc_feature 15: n = A,T,C or G
aaagtatctgaagangtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacggggagtaaattcagcattaaaataaatgtaact

SEQ ID NO: 53669 - DNA, 310 bp, Homo sapiens
agtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctctgtaagaaaaccaaaaaaaaaaaaaaaaaaaaaa

SEQ ID NO: 53670 - DNA, 460 bp, Homo sapiens
  misc_feature 51: n = A,T,C or G
aggcattgaggcagccagcgcaggggcttctgctgagggggcaggcggagnttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagatt

SEQ ID NO: 53671 - DNA, 273 bp, Homo sapiens
  misc_feature 155: n = A,T,C or G
agatattgcaccctatgacattggtggtcctgatcaagaatttggtgtggacgttggccctgtttgctttttataaaccaaactctatctgaaatcccaacaaaaaaaaatttaactccatatgtgttcctcttggtctaatcttgtcaaccagngcaagtgaccgacaaaattccagttatttatttccaaaatgtttggaaacagtataatttgacaaagaaaaatgatacttctctttttttgctgttccaccaaatacaattcaaatgc

SEQ ID NO: 53672 - DNA, 361 bp, Homo sapiens
  misc_feature 5: n = A,T,C or G
cgaanagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgtttaaaaaaaaaaaaaaaaaa

SEQ ID NO: 53673 - DNA, 313 bp, Homo sapiens
  misc_feature 17, 24: n = A,T,C or G
ttaaaaaaaaatccgantgaatantaaatgcctaatttccttctttgtgaaatggttgcttcctcctgattccctaattgtgctgtgttcgtgtcttgcactggaattcaacattcccttctccttttgtgctgtgttgtgcttgcttgtctctcccggacacccttaaagactgtctttttagcaaaaaatttcagtaaagtgttttctgtaatctttttttaaaaggtgagaactaattattgtccatacttgtagcattcttcattaaagtcttgcttctctcaaccaaaaaaaaaaaaaaaaaaaaaaa

SEQ ID NO: 53674 - DNA, 480 bp, Homo sapiens
acatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaatt

SEQ ID NO: 53675 - DNA, 300 bp, Homo sapiens
  misc_feature 9, 27, 30, 31, 66, 94, 104, 155, 245: n = A,T,C or G
acccttggnccccagggacctcggccnctnnggccgggactgtacctacttggttgttaacatggncctatttgaaatgtataagtccataaantagaaaagancaagtgaattgttgctatttaaaaaaaattttacaattcttactaaggagnttttattgtgtaatcactaagtctttgtagataaagcagatggggagttacggagttgtacctttactggctgaaagatatattcgaatngtaaagatgctttttctcatgcgttgaaattatacattatttgtagggaattgca

SEQ ID NO: 53676 - DNA, 123 bp, Homo sapiens
  misc_feature 14, 28, 30, 61, 105: n = A,T,C or G
ctgaaatcctgaancccctctttgcctntntttccacggaagaagggcctgggccccgtgnagcctcagtgcccgtttggcctgctgctctcgctgacaataaanagcccttgcgttgacctg

SEQ ID NO: 53677 - DNA, 510 bp, Homo sapiens
  misc_feature 43, 454: n = A,T,C or G
agcagaagcaataatgtttgctttaaaagacttcttgacctangccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaatagggtcgttgactccctnctagtagagctatctaaggtttgtctggaaagttttccgaccctggcttataggca

SEQ ID NO: 53678 - DNA, 500 bp, Homo sapiens
  misc_feature 19, 30, 37: n = A,T,C or G
cactcggaaactcaagtanttctcaagaangccctcntttttcaacctggcaaaatcttgttaatgtccttgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatatttcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtaaattcaatacaggctatgtaaaatttt

SEQ ID NO: 53679 - DNA, 160 bp, Homo sapiens
  misc_feature 40, 48, 60: n = A,T,C or G
aaaacagttggcaaaaattggaactctacacctactaganttagattnctgtagtacganttaccttcggtgttaaaatttcctgaagttgatcactatacttgtgattctgtaaaagaaaatccttgttgtaaggtgaaaacaaaaaaaaaaaaaaaaa

SEQ ID NO: 53680 - DNA, 440 bp, Homo sapiens
  misc_feature 27, 31: n = A,T,C or G
agtcaaggggaaccagtgggtgggctntgangatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggtttttgttttcctgcagctgatgacttgttgcccttgaagtacaataaaaaaaattcattttgctcccaaaaaaaaaaaaaaaaaaaaaaa

SEQ ID NO: 53681 - DNA, 430 bp, Homo sapiens
cttgcgtacctgggccgggtctgtccacactgcgcttgttttcctgggattgaatgctggtgggaagggttctccaaaaaatgtggaatcctttgcatctatgctgagacattctacctcttacacagatgggacctgcaaaggataaactggtcattggacggatctttcatattgtggagaatgatctgtacatagattttggtggaaagtttcattgtgtatgtacgaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactccaagatcgaaagaagaacatcatgaaaaataaatgaacttt

SEQ ID NO: 53682 - DNA, 335 bp, Homo sapiens
  misc_feature 29, 37, 122: n = A,T,C or G
cgtcctcgttttggaaaagcgtcgcaatnaagaccgnaccaccgtttgtgcccgcccgcttgtggcttcttaaggccctacccacctttcagaaagtcgaccctgtggcaaaaatgtggctnccccttgccaagcgcaagaagaaaagtattaacctggagtgccaaggttaaaaagaccgaaaatacccaccggaactggtcgaatgaggcacctaaaaattgtataccgcagattcaggcatggattccgtgaaggaacaacacctaaacccaagaaggcagcttgttgcagcatccagttcatcttaaagaatgtcaaacgattagtcatgc

SEQ ID NO: 53683 - DNA, 410 bp, Homo sapiens
  misc_feature 21, 53, 111: n = A,T,C or G
ccaggacctgtctcctcgaantctgctgggagatgacaccacagactgttccntccctttcctgtatacttctctgtactactgtcgattcgacagaacacttcagaagantctcggcctttgcccctttcacgagccgccaccaagcaggcaggttggatttcttggcccaccacctccttcttgggaagttctcttgaactcaagaactctttattttctatcattctttctagacacacacacatcagactggcaactgttttgtagcaagagccataggtagccttactacttgggcctctttctagttttgaattatttctaagccttttgggtatgattaagagtggaaaatggcagccagcaaacttgatagtgcttttggtcctagatgatttttatcaaat

SEQ ID NO: 53684 - DNA, 227 bp, Homo sapiens
  misc_feature 8, 196: n = A,T,C or G
tctgcaanttgtagttgttacctgatcaaagtttaacttgcttcctttttgtttaaaaagggatacctgatgtcagaaaatctgtaatatgttttacttcaaaagatgtaaataatgtatacagacttgtatgtgatgggatgggaaatatttaaattctaggtgttttttttttaaagaagaaactcaatgtttntaaaaaaaaaaaaaaaaaaaaaaaaaaaaaa

SEQ ID NO: 53685 - DNA, 450 bp, Homo sapiens
  misc_feature 17, 21, 47: n = A,T,C or G
ctgtgtgagtagtgtantaanttttaaaacttaaacaaactgtgtantttcaattagaggaggactttttgttttttaaatgtagctcttttagaaaacgatgaaaaggatgaagaggatatgtctctggattcaggggatgaagtctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcatttttaatggttctcactc

SEQ ID NO: 53686 - DNA, 250 bp, Homo sapiens
ttgggaaaatgggcaatttgacagagaccccttttccctaacacactctactgtgctagtacttttaactttttaaaattttactttctacgttttgtaatataaaaaatttctcttttaagtttagaatgttatacgtacccgaaagtatgcagccaaatcgatcagatcaaaccattttacctggagtttggacctggtttttactttctctgaatctgtataagaaaaataaagacaattgaacttc

SEQ ID NO: 53687 - DNA, 420 bp, Homo sapiens
  misc_feature 37: n = A,T,C or G
gaggtctgtgtatgctcacttccccatcaacgttgtnatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggtaaaaaaaaaaaaaaaaa

SEQ ID NO: 53688 - DNA, 500 bp, Homo sapiens
  misc_feature 486: n = A,T,C or G
cacacatgtgtgacaatgacttatgtctccacagccccaactaccatctaacaaaaactacatgacagaccctgagtaaaattttcccactagaaccaagtcaacccacagtccataaagataagaaaaaattattgttttaatccagtatggtttgtttcatagcaaaagataaaaagaatagacactacttgtaggaatgaaaaagtctagggacaatgttgttggcttatttttttttgttgacttttggtttgatttatttagaaagtagacctgaaatgtacgtaagctgaggatttgaattcagaagagagagaaacttaagttacaagaaagccttcacataatgaaagcaagggcctggaaaagacaataaaaatgtgttcaagatcctagggaaaggagtttgtcttagcaagcaaaataaatacctcttcttctgagaaagaataaatgagaagagaaagagcaaagtttgaggtntaggagtaagaact

SEQ ID NO: 53689 - DNA, 228 bp, Homo sapiens
  misc_feature 12: n = A,T,C or G
accagcctgacnaacatggtgaaaaccccgtctccaccaaaaatacaaagagtagctgggtgtggtggtgccgctcctgtagtcccagctgctcgggagggtaaggcaggagaattgcttgaacctgagaggcggaggttgcaagtgagccaggatcgcgccactgcactccagccttgccaacagagcaagacttcatcacaaaaaaaaaaaaaaaaaaaaaaaaaa

SEQ ID NO: 53690 - DNA, 500 bp, Homo sapiens
  misc_feature 47: n = A,T,C or G
cagaaaaggcttttgataaaaattcaacatcccttcatgttaaactntttcaaaaaattagatattgaaggaacatactaaaaataataagagccatctatgataaacccacacccaacatcatactgaatgggcaaaagctggaagcattcctcttgaaaaccagcaacaggaaacgattccctctgtcaccatttcttttcaacatagtatttggaagtcctggccagagcaatcaggtaagagaaagaaataaaggacgcccaaaaaaaccatagagtatgtcaaactgtttgcagttgacatattctctatctacaaaaccccatagtcttggctcaaaagctccttcatctgataaacaacttcagaaaagttgcaggatacaaaatcaatgtacaaaaatcacttgttttcctataaaccaacaacaatcaaatcaggaaggcaatcccattcacaattgccacacacacaaaaaatacctaggaatacagcaa

SEQ ID NO: 53691 - DNA, 250 bp, Homo sapiens
  misc_feature 20, 50, 59: n = A,T,C or G
ctgactttaaaaccctcacntgagagcgcaaaaatgcagcttttactacnttttttacnttttcaattgcctagcacaattagtgagtacattttgaatttgaatattttaataaaatatttgcaaaataaaatccatctaaataggaagggttcttgttttattttggaaaaattggaatctttaaactattcataatcttgaatgactgtcatctttctagttttcagaaaaataatgtattccttat

SEQ ID NO: 53692 - DNA, 380 bp, Homo sapiens
  misc_feature 278: n = A,T,C or G
actgaccaaaattttaagtaggaaagtcacccaaacactttctgcttttcactttaagtgtctggcccgcaatacttgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggnggggtgattattttttatactgtatgtgccaaagctttactactgtggaaagacaactgttttaataaaagatttacattccggaaaaaaaaaaaaaaaaaa

SEQ ID NO: 53693 - DNA, 500 bp, Homo sapiens
  misc_feature 2: n = A,T,C or G
antagcttttccaatcttgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatggtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttaagttt

SEQ ID NO: 53694 - DNA, 220 bp, Homo sapiens
tggagtgccatgcagtctgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaaaaaaaaaaaaaaaaaaaaaaaaaaaaaaaaaaaa

SEQ ID NO: 53695 - DNA, 222 bp, Homo sapiens
  misc_feature 35, 46, 56, 61, 78, 79: n = A,T,C or G
gaagtgttcaaagcaggccccgagcccgcctggantcccgcagctnaggaactaantggantaggacccgcggttctnnttttgtttggttttcggaactgaggccatgattaaagaagggacggccgggggcattcgtattgcgccgctagaggtgaaattcttggaccggcgcaagacggaccagagcgaaagcatttgccaagaatgttttcattaatc

SEQ ID NO: 53696 - DNA, 341 bp, Homo sapiens
  misc_feature 65: n = A,T,C or G
tggagctgaagacctaaagtgcttgcttttttgcccgttgaccagataaatagaactctctgcanttactctctgcagcatggggtttttacttactttttacctaaagacgtctcttttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataataaaaaaaaaaaaaaaaaaaaaaaa

SEQ ID NO: 53697 - DNA, 450 bp, Homo sapiens
  misc_feature 2: n = A,T,C or G
cnaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatattggaagacactgatgatgatgatgatgatgatgatgatgatggtgatgatgaggacaactctctttttccaacaagagagccaagaagccattttttttccatttgatctgtttccaat

SEQ ID NO: 53698 - DNA, 480 bp, Homo sapiens
  misc_feature 88: n = A,T,C or G
tcggtgagcggtggtggtttacttcttccgtggagttaagggctccgtggacattctcaggtcttcagggtcttccctctggaactantataaagttcagaaaacatgtctcgaagatatgactccaggaccactattattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttatttacagtatcaggagccaataccttgtgagcagttggttacagcgctgtgtgatatcaaacaagcttatacacaatttg

SEQ ID NO: 53699 - DNA, 170 bp, Homo sapiens
  misc_feature 83, 149: n = A,T,C or G
ggttacgaatataatgctgacaaatgtggatggaggggaagatactgctttagcctatcactccttattttattttgtttggntttatgccctcagtgtcttagggaactttttaagagatcctctgctaccaaacaatgatggggatncttttgcacagaaatatttaa

SEQ ID NO: 53700 - DNA, 120 bp, Homo sapiens
tgtttaaaactaatttcttaaaataaagccttcagtaaatgttcatttaccaacttgataaatgctactcattaagagctggtttggggctatagcatatgcttttttttttttaattat

SEQ ID NO: 53701 - DNA, 404 bp, Homo sapiens
  misc_feature 45: n = A,T,C or G
gagacagacagttgcggtgggtgtcctcaaagcagtggacaaganggctgctggagctggcaaggtcaccaagtctgcccagaaagctcagaaggctaaatgaaatcttctccctaatacctgccaccccacttcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaagtttttaaaatcagtactttttaatggaaacaacttgaccaaaaatttgtcacagaattttgagacccaaaaaaaaaaaaaaaaaaaaaaaaa

SEQ ID NO: 53702 - DNA, 361 bp, Homo sapiens
  misc_feature 63, 254: n = A,T,C or G
tgctgaggaacgcactgctaatcagagtgactgtgtctgcatcggatcctaggagatttcctngtagctgcaatgagtatcaggaggcaatggaccagtatagtatagcactaaggtaggcactagcctcccttgggggaaggccactgaggagggtagaaggaggcagtgagctgtgcacaggagttatggaaacacacacacactttgtgccatggttgaaagcagaataataatagtaatggtagaagagntatttgtgaatcatgacttctaaaaattttttcttaaaatatattaacaacattagagactgttcactcataaccatccacaccactataacatctgggtcatttgg

SEQ ID NO: 53703 - DNA, 329 bp, Homo sapiens
  misc_feature 2, 11, 30, 256, 259, 274: n = A,T,C or G
anagtcacccnaacacttctgctctcactnaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacgaaaaaaattgtattgaaaacacttagtatgcagttgataagaggaatttggtataattatggtgggngantattttttatactgnatgtgccaaagctttactactgtggaaagacaactgtttaataaaagattacatt

SEQ ID NO: 53704 - DNA, 357 bp, Homo sapiens
  misc_feature 6, 10, 29, 30, 32, 35, 50: n = A,T,C or G
cgcaanagtnctttacttctcttaggtgnntntgngaatgggagaggggnaggatgtcaggggtagtttgttttagaaccagccgtattttacatgaagctgtataattaattgtcattatttttgttagcaaagattaaatgtgcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagacttttg

SEQ ID NO: 53705 - DNA, 364 bp, Homo sapiens
  misc_feature 3, 57, 58, 67: n = A,T,C or G
aangactgattctctctagagcctttggaggaagcgtgaccctgccgacaccttaanntctaacttntggccttgagaaccaggagagaatacacttctgctgttttaagtttgtggtaagtttgtcgtggcaaatttaggatgcagatacaggtactaagagcaaaaagccaactgctgcagggactggcgggtatagcacctgggtcaaacacctggatggccccgctggaaggcagctgtcctccactccagtccacagcggacagcagaatgtggcccagagacaccagatcttctgatttctcatgagaaattgaacatctgagcttttaaataaaatctcctgatctttaaactttca

SEQ ID NO: 53706 - DNA, 398 bp, Homo sapiens
  misc_feature 2, 21, 55, 321, 357, 365: n = A,T,C or G
cngggatctccagggatgttnaacatttataattgcaaaataaaccaactataanaaaagaaactaagagagaattggtactttaattacttgtgtgtttgcaaataggctccattttccatgttgagtaagattataaccttattaactatgcataggcctaagaaaggtggcaatgaactgtgcatgtaaattttaaatgggtactttgtgcaattcgttaaaagaagatctctatgaatatgattctatatattgaaatcagaaaacctaccaaacaaaaacatcagaagctgctgcataatgactattttctactgnaggctgcttggaaataattcccatatcctgctttgnaaggtggnaatatcactatgcatttctacacatttataaat

SEQ ID NO: 53707 - DNA, 394 bp, Homo sapiens
  misc_feature 1, 208, 210, 211, 247, 288, 301, 302, 321, 368, 375, 383: n = A,T,C or G
ncgggtataacatgcagtatatttcaaaatttttaaattatgtgtaaatttgattttatttgttaccatgttaagactattgtgcatttaatgaagcattattatgctatcaactttaacctatcccatgttactcaagggtgtagctaaatgaaggtagcagtatgctatttagtaacatagtggaatagcatctctagtaatctcntnngccagtagctttaactggcagataagttaatattgncccataggttaaatatttatcctttttttgatatttaaatncttttcttatttnntgggggacataatatgggnatatatttatgcaaatctggcatattttgatagagcatacaatatgnaataatnacatcaantacatcagggg

SEQ ID NO: 53708 - DNA, 364 bp, Homo sapiens
  misc_feature 5: n = A,T,C or G
gatcncggtgtgttcttgactccgctgctcgcatgtcttctcacaagactttcaggattaagcgattcctgccaagaaacaaaagcaaaatcgtcccattccccagtggattcggatgaaaactggaaataaaatcaaggtacaactccaaaaggagacattggaagaagaaccaagctgggtctataaggaattgcacatgagatggcacacatatttatgctgcttgaaggtcacgatcatgttaccatatcaagctgaaaatgtcaccactatctggagatttcgacgtgttttcctctctgaatctgtatgaacacgttggttgctggatcagtaataaatatgtaaggcctttcttttg

SEQ ID NO: 53709 - DNA, 375 bp, Homo sapiens
  misc_feature 3, 334, 359: n = A,T,C or G
cgnaggagcccacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgcttgntcataaattgacaatgcaataaatngaaatatgggtcactg

SEQ ID NO: 53710 - DNA, 151 bp, Homo sapiens
  misc_feature 3, 14, 138, 149: n = A,T,C or G
cgnctgtaaaatgngggcgctattgcttcagctgctgaagggaggaggctggctctgagagccccaggactggctgccccgtgacacatgctctaagaagctcgtttcttagacctcttcctggaataaacatctggnctgtgtctgcngg

SEQ ID NO: 53711 - DNA, 151 bp, Homo sapiens
  misc_feature 7, 9, 27, 28, 39, 48, 97, 138, 141: n = A,T,C or G
tgggagncngtctcattggcgcctttnncctcagctgtnttccaagcntgatgggccactgtgaaaaaattttttaaaaatgtgaaatgaaatgttnttacagcaacaatatgaaatatattttataaggaataaaanggnaccttgtctg

SEQ ID NO: 53712 - DNA, 340 bp, Homo sapiens
  misc_feature 3, 18, 28, 38, 41, 48, 51, 324: n = A,T,C or G
atncgttgtaaagagaancaaaaccacnatgagagatngtnttacccncgntagaatgacagacaccaaaagacagtaacaaatgctgacgagaatgcagagcaaaggaacgtttaaacaccgttagtgggaatgtagacttgtacaaccgttatggagaagagtatggaggttcctgaacaaactaaaaatagaactaccatatgattcagcagtcccactactgggtatatatccaaaagaaaatccatatatggagacatctgcacctgccatgctcgttccagcactattcacagtacccaagattggaatcaacctgtnctatcagcaaatgaac

SEQ ID NO: 53713 - DNA, 110 bp, Homo sapiens
  misc_feature 10, 22, 31, 36, 39, 55, 66, 75, 88, 92: n = A,T,C or G
gccctagagnactcaagtgttngacaccaanagctnttnaggctgcccctaagcnatgtgcaattntttctggtnccccaaagtgtantttnctctaagtcgagggctat

SEQ ID NO: 53714 - DNA, 398 bp, Homo sapiens
  misc_feature 1, 10, 55, 287: n = A,T,C or G
ncgggcattncgggaagacccaaagctaaagggggagcaaatattaagaaaatancaactggcaagccatttcacaatctattcctctttaagaatccaaaagtatctatctcagtatctactgtcctacacaagatatccggctttcagcaaaatattatgaccatatgaaaaggcaagagaaagcactccgaagagataatacacataaacatgtgatatatgggacacatataaaaattatcacgcaaggaatttaaagtaactatgattaatattttaaaggnctaaaggaaaaggttgaccacatgtgagatcagataggtaatttcagaggagatatggaactaagaaaaatcaaatggaaatgctagaaattaaaaacatagtcaaggaga

SEQ ID NO: 53715 - DNA, 149 bp, Homo sapiens
  misc_feature 5: n = A,T,C or G
attgncaccaaaggccaaataataaacagcctttagtttttaaagtaaaattcattctatttgcagagtacacttgtatggtagactgttaaagacaattttatgactatttatgcacattataatggttacatctgctttttgcttta

SEQ ID NO: 53716 - DNA, 326 bp, Homo sapiens
  misc_feature 3: n = A,T,C or G
cgnagaggccctgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaagg

SEQ ID NO: 53717 - DNA, 288 bp, Homo sapiens
  misc_feature 8, 15, 29, 30, 52, 55, 70, 216, 255: n = A,T,C or G
ggaccagnacgaganaaaaaaggtcttgnngaggggccgacatttcatctgnccncattctctgcgcctntcgcagagcttccagcagcggtatgttgggccagagcatccggaggttcacaacctcttgtgggtccgaggagccactatgaggagggccctgggaagaatttgccattttcagtggaaaacaagtggcggtactagctaagatgngttgtactttggatctgcatttgctacacccttccttgnagtaagacaccaactgcttaaaacataaggatg

SEQ ID NO: 53718 - DNA, 155 bp, Homo sapiens
  misc_feature 18, 24, 47, 51, 54, 66, 68, 84, 103: n = A,T,C or G
cccaaaatataaggggtntagaanaccctgcgtgaaatattgctatntttnctnagcaggatatgncnacagtgaattacatangtcatgattgttctacgtntcatatattatatgggtgctgtgtatatgccactaataaaatgaatctaagc

SEQ ID NO: 53719 - DNA, 217 bp, Homo sapiens
  misc_feature 8, 20, 29, 31, 32, 34, 38, 39, 216: n = A,T,C or G
aacctagncacagagcagcncctaccccntnntncttnncacacctgcgaactcttgtacttgggcttgaatatttagtgtaattacatctcagctttgagggctcctgtggcaaattcccggattaaaaggtatggttttcaataattgtcctgaactctgctacagactaataaaacttcggtcaagttgcgagcaaaagggattatttggtgng

SEQ ID NO: 53720 - DNA, 107 bp, Homo sapiens
  misc_feature 4, 8, 31, 34, 41, 88, 96: n = A,T,C or G
agcnttancttgctcgaggctagaataaacnggncgagaanacacatagtatattgtaatatgtatataagaaagctctttattttcnacctcacnaccctactgaa

SEQ ID NO: 53721 - DNA, 211 bp, Homo sapiens
  misc_feature 5, 6, 34, 40, 41, 179, 195: n = A,T,C or G
caaanncaccataatgcaatataaaatattaganccctgnntacaggagcctcacagcatgaaaagtttctcatttgtggtgatcaaaataaattaacttgaaattgtttccactgaaaataactacttgacatctagatattaaatacacacacacacacacacacacacacacatanacacactggaccaatnaccatcaattcaaggt

SEQ ID NO: 53722 - DNA, 231 bp, Homo sapiens
  misc_feature 1, 93, 170, 187, 196: n = A,T,C or G
ncgggggtagccaataaaataatggagaagtgttaatatgtatacaaaaaggtaaatattgatatatctactctctgttgggggcaagaaggncattttaagttattcaaagcactttcttaagcattttagaaagcctttattctttgctggtggaagtctccgtactntgcagaattggtatttngtgtactancctctgccgcaggatgggggaggtgggcaaggtag

SEQ ID NO: 53723 - DNA, 174 bp, Homo sapiens
  misc_feature 1, 10, 76: n = A,T,C or G
ncgggattgnctttgaagcttattccctatcagataatgattatgacggaattaagaaattactgcagcagctttntctaaaggctcctgtgaacactgcagaactaacagatctcttaattcaacagaccatattgggagtgtgattaagcaaacggatgtttcagaagacag

SEQ ID NO: 53724 - DNA, 128 bp, Homo sapiens
  misc_feature 3, 16, 29, 40, 44, 47, 57, 69, 79, 84, 105, 125: n = A,T,C or G
acngttgtgttggganaaaatgaagattncatcaaggtgngaantgnaagaaattgnaaaagcgggttngggcgggcantactngcagacgctcttagtccgagngcgaggattatattcatcgngga

SEQ ID NO: 53725 - DNA, 378 bp, Homo sapiens
  misc_feature 15, 17, 34, 43, 47, 53, 61, 167, 180, 339: n = A,T,C or G
ataaattatcagggntngaatgacacacagcctngaaaatgtnggcncctttnaagtcaangagggcctagagtaggaaggattgtgaacattcacaggatagttgccagaaatgaagtatttgacaccattcttgcaactcctaagtaagctaaatagcgcagggntaggagttggctntctcatgagatcaagataaatgtaagctgtggaatttttactttgcataggatttcttcatccaatcagcagccctttgcagatcctacaatgtgcagaacctgcttaagccttcacatctaggaggctaaaggttgagttggctggttcatcctgctngctgatcacatgcacatacaccacacactcactgcatac

SEQ ID NO: 53726 - DNA, 183 bp, Homo sapiens
  misc_feature 13, 39, 45, 55, 58, 63, 64, 150, 159: n = A,T,C or G
gcccagtgccttnggtgctggtgcttgcaataaagaaanaatttnctggaaaggnagnctgcnnaagagggaaccgggtgactcagaaagacagatgttttggtaatttaccccaaatgtgccatccacatagtgctttttcctcttgcncttcgggtnggttgaatctcacaattatgtatt

SEQ ID NO: 53727 - DNA, 398 bp, Homo sapiens
  misc_feature 3, 9, 91, 335: n = A,T,C or G
cgngacctncagaagctagagaggaaatcagtgggatcccctgagcagtgatatttgtgatgacatcaaagtggacatgctgtggaattgnacactggtgccccaagcgaggagttgagcagtgctggagaagtaacgaaacagacagtcttacagaaggaagaggagaggagcagccaactaaaaccccttcatcttctcaagagccccctgatgaaggacctcagggacagatgtgaacaaaggatcatcaaagaatgctttgcctcagtggatcctgaagtgaggcttagtagccccccagggaaccagaagattcatccagtgttgatggncagcagtggggctccagttggccagaactggaggagagaagaatgggccagaagaagaggaag

SEQ ID NO: 53728 - DNA, 262 bp, Homo sapiens
  misc_feature 12, 18, 41, 45, 51, 123: n = A,T,C or G
cggaggctcccngcctgnaatcccaacactctgggaggacngttngaggtnaggatttcaggaccagcctgggcaacatagcaagaccccacctctaaaataatttaaagaaattagcctggngtggtgttgcacgcctgtagtcccagctacttgggagactgaggcaggaggatcacttgagcccaggggtttgagaccgcagttagccatgattgtgtcactgcactccagcctgggtgacagagtgagactctcttac

SEQ ID NO: 53729 - DNA, 324 bp, Homo sapiens
  misc_feature 5: n = A,T,C or G
gtgancaacttgtagtagttgacttctcagccacgtggtgtggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattaagtctaatcatgttttctgaaaacataaccagccattgctatttaaaacttgtaattttttaatttac

SEQ ID NO: 53730 - DNA, 358 bp, Homo sapiens
  misc_feature 1, 4: n = A,T,C or G
nctncctgtgcgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggcaaaaagaagaagtggtccaaaggcaaagttcgggacaagctcaataacttagtcttgtttgacaaagctacctatgataaactcttgtaagggaagttcccaactataaacttataaccccagctgtggctctgagagactgaagattcgaggctccctggccagggcaagccttcaggagctccttagtaaaggacttatcaaactgg

SEQ ID NO: 53731 - DNA, 363 bp, Homo sapiens
  misc_feature 3, 34, 43, 49, 101, 136, 196, 199, 327: n = A,T,C or G
tgnatatatacaacgtgataaatgctaagtgtgngctaaggcncatggnagaccgacgacatgtgcacaaggtactgagatttttttcaagaaacagctgncaaatctcaaggtgaagatctaaatgtgaacagtntactaatgcactactgaagtttaaatctgtggcacaatcaatgtaagcatggggtttgtntcnctaaattgatttgtaatctgaaattactgaacaactcctattcccatttttgctaaactcaatttctggtttgggtatatatccattccagcttaatgcctctaatttaatgccaacaaaattggtgnaatcaaattttaaaataataataatttgccccccct

SEQ ID NO: 53732 - DNA, 355 bp, Homo sapiens
  misc_feature 2, 15, 29, 35, 45, 53, 56, 66, 69: n = A,T,C or G
gncagagccaatgtntatgcataaatatncaaaancatgctggantgagaaanggnatggcaaaancgnggaaaagagttgcttgaaattctaacaccatgtatttccagggtccaacagttaatgctgtatcagccgttaggattttatcagtattaactgagattattgaggaaggcttcttagaactgggataacatggaactggaccttgaaattagaaaatatttagaactgtcgataatgaaagcagtacatcgaatttgtgagattcagctatacctgtgttcagatggaaatgtacagcacaaaatataaactgttaagcaaaagaaatagcattataaagcaaagc

SEQ ID NO: 53733 - DNA, 258 bp, Homo sapiens
  misc_feature 9, 41, 129: n = A,T,C or G
acgcctgcnagctcccagcactttgggaggccgaggcgggnggatcacgaggcagggagttcgagaccagcctaatcaacatggtgaaaccccatctctactaaaaatacagaaattagctgggcgtgnggcacacgccttgtagtcccagctactcgggaggctgaagcaggggaatcgcttgaacccggaggcggaggttgcagtgagctgagatcacgccactgcactccagcctgggtgacagagcgagactct

SEQ ID NO: 53734 - DNA, 398 bp, Homo sapiens
  misc_feature 1, 33, 40, 47, 55, 56, 196, 331: n = A,T,C or G
ncagggagtcccgagtggagagagcgagctgantggttgngtggcgnagtctcgnntaccggtagcgcttgcagcatggctgaccaactgactgaagagcagattgcagaattcaaagaagctttttcactatttgacaaagatggtgatggaactataacaacaaaggaattggggaactgtaatgagatctctngggcagaatcccacagaagcagagttacaggacatgattaatgaagtagatgctgatggtaatgcacaattgacttccctgaatttctgacaatgatgcaagaaaaatgaaagacacagacagtgaagaagaaantagagaacattccgggtgtttgataaggatgcaatgctatattagtgctgcagaacttcgccatgtg

SEQ ID NO: 53735 - DNA, 375 bp, Homo sapiens
  misc_feature 54, 56, 60, 61, 72, 75, 140, 146, 205, 216, 247, 306, 330: n = A,T,C or G
ggatacactcctaatagattgatgtagtcataaaagggggacaagtagatgttntnctgnnatgtaagcaanaanttttccgtgtcttattgagtatggctaagcggattatttattacatgctagatgggtctttgcangtgggnccatatagggtgcagaaatttcctcagccactggagggatttcgaccatatttgcattnggatgagctgntattagattgaaatctacacatcatttcatnaaaaattgtgccttagaaaacgcaaagctgttgcacatgcgataaattatggatgcagnacattgaagagagatgaagcactnccaagtttccaagacttctcatggaggtgtttgctggtttacagg

SEQ ID NO: 53736 - DNA, 398 bp, Homo sapiens
  misc_feature 1, 4, 78, 109, 286, 296, 306, 366: n = A,T,C or G
ncgngggagcctgtcgatcccaggccagagacaaggcagacaaaggttcatttgtaaagaagctccttccagcacctnctctcttctcctttgcccaaactcacccagngagtgtgagcatttaagaagcatcctctgcaagaccaaaaggaaagaagaaaaaggccaaaagccaaaatgaaactgatggacttgttttcaccattggctaactttgctgctaggagtcaagccatgcctgcaaatcgctctcttgctacagaaagatctaaaagatcacaactgncacaaccttncggaaggagnagctgacctgacacagattgatgcaatgtccaggatcatttctgggatgggaagggatgngagatgatctgttactgcacttcagcgaattg

SEQ ID NO: 53737 - DNA, 399 bp, Homo sapiens
  misc_feature 4, 33, 34, 49, 75, 129, 131, 156, 181, 298, 307: n = A,T,C or G
actnaatggaaagggttatggagcaagtgatcnntaaatatttaagggnagacctgaagaccattattttctttngactgaacctccattgaatactccagaaaacagggaatatactgctgaaataangnttgagtccttcaatggtccaggctngtacattgctgtgcaggctgttctngccttagctgcatcttggacctcaagacaagtaggagaacggacgttgaccggtacggtaataagacagtggagatggtgcactcatgtcattcctgtggctgaagggtatgtgatngcaagctgnattaaacacattccaatcgcaggacgagatataacatattttattcaggcaactgctgagagaccgagaagtaggaatccctccagacaatc

SEQ ID NO: 53738 - DNA, 229 bp, Homo sapiens
  misc_feature 2, 5: n = A,T,C or G
anccnaaccaaggaaggaaacgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgcagttcaaaaataagcttttttgttgttgttgaagatgaagtgtgtaaggtgaaccaaaaag

SEQ ID NO: 53739 - DNA, 346 bp, Homo sapiens
  misc_feature 4, 30, 33, 306: n = A,T,C or G
gggngtttccaattgataaaatatttaggnacnaataacaaggactaataatattttcttatttaaaaaaagcatgggaagatttttatttatcaaaatatagaggaaatgtagacaaaatggatataaatgaaaattaccatgttgtaaaaccttgaaaatcagattctaactgggatttgtatgcaactaagtatttttctgaacacctatgcaggcttatttacagtagttactaagggacacacaaagaattacacaacgttttcctcaagaaaatgggtacaaaacacacccgaggagcgnatacagttgaaaacatttttggtttgattggaagcagata

SEQ ID NO: 53740 - DNA, 400 bp, Homo sapiens
  misc_feature 5, 12: n = A,T,C or G
gctanccctagncccaaacccactccaccttactaccagacaaccttaaccaaaccatttacccaaataaagtataggcgatagaaattgaaacctggcgcaatagatatagtaccgcaagggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagctggttgccaagatagaatcttagttcaactttaaatttgccacagaaccctct

SEQ ID NO: 53741 - DNA, 400 bp, Homo sapiens
  misc_feature 2, 10, 28, 112: n = A,T,C or G
gngatcccgnatgaggactctggctgcnggaataggacactcaagacttttgactgccattttgtttgttcaagtggagactccctgccaacagaatccttcttgatagttngcaggcaaaacaaatgtaatgttgcagatccgcaggcagaagctctgccttctgtatcctatgtatgcagtgtgctttttcttgccagcttggccattcttgcttagacagtcagcatttgctcctcctttaactgagtcatcatcttagtccaactaatgcagtcgatacaatgcgtagatagaagaagccccacgggagccaggatgggactggtcgggttgtgcttttctccaagcagcacccaaaggcaatgccagagaccccgggtgggtgaacgctggttct

SEQ ID NO: 53742 - DNA, 396 bp, Homo sapiens
  misc_feature 4, 6, 395: n = A,T,C or G
aatncntgctttacacgttttggaaatgagtgcaaaccctcttgataattatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggctaggaaacaacaaaatcacagatatcgaaaatgggagtcttgctaacataccacgtgtgagaagaaatacatttggaaaacaataaactaaaaaaaatccttcaggattaccagagttgaaatacctccagataatcttccttcattctaattcaattgnc

SEQ ID NO: 53743 - DNA, 357 bp, Homo sapiens
  misc_feature 5, 53, 267, 270, 281, 327: n = A,T,C or G
gaaangatatgaccaaaattttaagtaggaaaggcacccaaacacttctgctntcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaattnggnataattatggngggtgattattttttatactgatgtgccaaagcttactactggggnaagacactgttttaataaaagattaccttc

SEQ ID NO: 53744 - DNA, 400 bp, Homo sapiens
  misc_feature 9, 16, 34, 398: n = A,T,C or G
aatcacagngaaactngaagaacagagaccaganagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgcatccacacaacaccaggacttaagacaaatgggactgatgcatcttgagctcttcatttattttgactgggatttatttggaggggggcattggttttaagaaaaacatgcatgnag

SEQ ID NO: 53745 - DNA, 281 bp, Homo sapiens
  misc_feature 12, 21: n = A,T,C or G
caaagcaggagnccactgagnaccggagacaggtgcagtccctcacctgtgaagtggatgcccttaaaggaaccaatgagtccctggaacgccagatgcgtgaaatggaagagaactttgccgttgaagctgctaactaccaagacactattggccgctgcaggatgagattcagaatatgaaggaggaaatggctcgtcaccttcgtgaataccaagacctgctcaatgttaagatggccttgacattgagattgccacctacaggaagctgctggaagg

SEQ ID NO: 53746 - DNA, 212 bp, Homo sapiens
  misc_feature 15, 24, 35, 39, 44, 45, 50, 54: n = A,T,C or G
agtaccagaaccaanttagaagantacttgaagcnaganggggnngccgnctanaaatcacatcaaaaagctactaaaaggactggtgtaatttaaaaaaaactaaggcagaaggcttttggaagaattagaagataaaaacatacttttagaagaaaaaagataaatttaaacctgaaaagtaggaagcagaagaaaaaagacaagctagg

SEQ ID NO: 53747 - DNA, 244 bp, Homo sapiens
  misc_feature 2, 6: n = A,T,C or G
gngcgncagaagcattcaagcagacggcttagtctggggctcatctaaactagttccagtgggatacggaattaagaaacttcaaatacagtgtgtaagttgaagatgataaagttggaacagatatgctggaggagcagatcactgcttttgaggactatgtgcagtccatggatgtggctgctttcaacaagatctaaaatccatccaggatcatggcatttaaataaaagattgaaagact

SEQ ID NO: 53748 - DNA, 250 bp, Homo sapiens
  misc_feature 1: n = A,T,C or G
ncgggattgccccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacgatgaaattgcccgctgaaaaaggagaataaagaactggcagaagtagcagaacatgtacag

SEQ ID NO: 53749 - DNA, 162 bp, Homo sapiens
  misc_feature 39, 146: n = A,T,C or G
tgtcacaatattagagcatactggttttgcctctaacgncgaggtgaccatctggtctttcttgctctgtaagagtttctgtttgtgcttttttttcccttacttttattatccagtttaaatccagtcagttggccaaaatggcntggaagaagggattta

SEQ ID NO: 53750 - DNA, 307 bp, Homo sapiens
  misc_feature 8, 36, 39, 43, 44, 45, 48, 59, 63, 64, 74, 149, 159, 252: n = A,T,C or G
aggatctncggagatgaggagtaaaattcagttttnttncagnnnctnttttgtgctgnttcnnaattagcggncaaggtgagcataaatcaactgtccatcaggtgaggtgtgctccatacccagcggttcttcatgagtagtgggcnatgcaggacntctgggagatttttttgagtcaaagacttaaagggcccaatgaattattatatacatactgcatcttggttatttctgaaggtaagcattctntggagttaaaatgccatatagaccatacacccaaacacttacaccaaactactga

SEQ ID NO: 53751 - DNA, 325 bp, Homo sapiens
  misc_feature 2, 8, 47, 77: n = A,T,C or G
gnggactnctaggggcttaagcggagggagtcagagccagcgtcagncgcgatgtttgttgttggagagcgagcagntcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatg

SEQ ID NO: 53752 - DNA, 400 bp, Homo sapiens
  misc_feature 5, 17, 30, 51, 55, 64, 258, 321, 362, 384: n = A,T,C or G
atggncggtgggatttnagtttagctacangcaatcctgaacttcctgaanatgnccttgatgngcagctggcattgccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggntgcaccgaaacacactggggaatggagcaaaacagtctttgaatatcgaacacgcaaggctgngagactacctattggaagatattgcaccctatgacattggnggccctgacaagaatttggggnggacgttggcctgttg

SEQ ID NO: 53753 - DNA, 365 bp, Homo sapiens
  misc_feature 16, 21, 27, 37, 39, 60, 62, 72, 145, 151, 200, 221, 239,302, 331, 344, 354: n = A,T,C or G
gcacacgacagatttntaganactttntgctgctagntntatgtaatatttattgaacantntgacaaatanttatttttgtaagcctaaaagtgattctttgaaagtttaaagaaacttgaccaaaagacagtacaaaaacacnggcacntgaatgttgaatgtcaccgtatgcgtgaaattatatatttcggggtagngtgagcttttaatgtttaagncatattaaactcttaagncaaattaagcagacccggcgttgcagtgtagctataactttctgatggtaggaaaaacaaaantggcgcttggaattaaatcatgccaaggntttgatacactgncttaagatantaatggaacac

SEQ ID NO: 53754 - DNA, 356 bp, Homo sapiens
  misc_feature 1, 55: n = A,T,C or G
ncgggatggccggaactgtcagatctcttagaagctgtggaaagtcaaagaagcnccatccatcccttcctgaatagatgtggttcagggaacgtgactttaaaggaggtagcatgtgatgggcaccaggatgagcagaaagccttgaatgccattccagtttatctctacaaagcagagggatctttacatatttgaaatattaaaaagatttggctttccaatatcaagaatgacacagattttgtaatgtcctacaaatatcctagacattaaaaagtgagaagaattatgagtgcatttgataacctagattaaatagcaaaattccttgaaaaacacaagtaatcatacat

SEQ ID NO: 53755 - DNA, 283 bp, Homo sapiens
  misc_feature 1, 12: n = A,T,C or G
ncggggtatccngcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtg

SEQ ID NO: 53756 - DNA, 349 bp, Homo sapiens
  misc_feature 3, 4, 25, 52, 75, 245, 301, 321: n = A,T,C or G
cgnngaaggccctgaccttcatggngtctttgaagcccaaccactcggtttncttcggattttcctccctttgtncggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgnaaacagtagacacccagaaatcgtgacttctgtgtctctccatttgagtattttgnaatttttttgaaatatttgnggacataaataaaaccaagctacactac

SEQ ID NO: 53757 - DNA, 198 bp, Homo sapiens
  misc_feature 13, 19, 27, 34, 47, 48, 55, 58, 95, 98, 129: n = A,T,C or G
gcggactcatgcnggaagngaagctcnactctanagttgacgtggcnnggaggcnacngacatggaattaagtcaagtttccggggaatcaccgncgntgccatcaacatgtccggcccaagcgctctnatgaagcaaccgccattcagtctacggctgggccgcccagttcgcaatgaggaaggtgagatttcaatg

SEQ ID NO: 53758 - DNA, 334 bp, Homo sapiens
  misc_feature 5, 303, 332: n = A,T,C or G
atttncaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcatgtgtacatgtattttttttctaggcaaacattgaatgcaaacggnattttttaatataaatatataactgtccntt

SEQ ID NO: 53759 - DNA, 365 bp, Homo sapiens
  misc_feature 6: n = A,T,C or G
attgcntgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgcccttttctaaaattaaaaagatcaaatttagtatttgctggatatgcagggagatgagactcttttaatctcaaaataaacagattctttcaag

SEQ ID NO: 53760 - DNA, 248 bp, Homo sapiens
  misc_feature 2, 12, 33, 35, 38, 39, 40, 42: n = A,T,C or G
cncctgcctganccagctgttgacaccattatncngcnnncngtgtttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattg

SEQ ID NO: 53761 - DNA, 126 bp, Homo sapiens
  misc_feature 11, 25, 32, 41, 58, 65, 71, 78: n = A,T,C or G
ccggcaagacnagacgagttgcggncagatanatcagcatnaaccttgagaatatcanaagtagnaagccnggctgcntgaaatgcatactagtttgattttagaaaaagaacaagtagaaattgc

SEQ ID NO: 53762 - DNA, 318 bp, Homo sapiens
  misc_feature 1: n = A,T,C or G
ncggggaagccaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttggtttttaagtgaattcagaaaatgttataaataaatcttttg

SEQ ID NO: 53763 - DNA, 273 bp, Homo sapiens
gattcctaagtaagcttaaagcttaaagctaaagcttctgaagttcttgtgagtttcagcatttaaactgcccggcttcttgtctagtcacaggaaggctaattttatcagttttataccacagaattacagtactgaccaagaattatttgttagaccagggggtctaggtcccacagagatgaatcctgtactatttgttttactgcttacattgcacaacagaagatatgtaagatcaagaaagaagtcattttccacatgcaaataagg

SEQ ID NO: 53764 - DNA, 297 bp, Homo sapiens
  misc_feature 4, 10: n = A,T,C or G
ccgnggaatncaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgctggcctggagctaggcaaggtggtgactaagaaattcagcaaccaggagacctgtgtggaaattggtgaaagtgtacgtggagaggatgctacattgttcagaggg

SEQ ID NO: 53765 - DNA, 393 bp, Homo sapiens
  misc_feature 12, 14, 30, 62, 241, 329, 358: n = A,T,C or G
gactcccggtgncnggagcgcaggattaanccttcgcggggcaaaatggagctcgaggccangagcagatataccagcccagtgaacccagctgtcttcccccatctgaccgtggtgcttttggccattggcatgttcttcaccgctggttcttcgtttacgaggtcacctctaccaagtacactcgtgatatctataaagagctcctcatctccttagtggcctcactcttcatgggctntggagcctcttcctgctgctctgggttgcatctacgtgtgagcacccaagggtaacaaccagatggcttcactgaaacctgcttttgnaaatactttttttactggtgctggaaggncccacctgctgctcataataaagcagatgtttgcg

SEQ ID NO: 53766 - DNA, 382 bp, Homo sapiens
  misc_feature 1, 18, 28, 40, 42, 43, 50, 51, 57, 58, 69: n = A,T,C or G
ncgaaacctgaagatganatcacctatnggcttaacagananngaaatgnncatgannactatggcgantactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcatttgg

SEQ ID NO: 53767 - DNA, 243 bp, Homo sapiens
  misc_feature 21, 48, 56, 69, 75: n = A,T,C or G
gcacccgactccagctagatngcctcccctggacatggcaatgatgantttttaanaaacagggcggangacganatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgctatgctt

SEQ ID NO: 53768 - DNA, 398 bp, Homo sapiens
  misc_feature 1, 10, 26, 262, 276, 379, 390: n = A,T,C or G
ncgggggaanctctgtttggtgcttnggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgacngcaggatgttgctncagagtgtgaagcaaatgcatgccaacattccagttttttaagaagggacaaaagggggcgaattttctggagccaataaggaaaagcctggaagccaccatnaatgaattagnctaatcat

SEQ ID NO: 53769 - DNA, 398 bp, Homo sapiens
  misc_feature 1, 4, 257, 302, 377, 392: n = A,T,C or G
ncgnggattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagactngctttcagcaaggactggctttctatctcttggactacactgaantcacccccactgaaaaagatgagtatgcctgccgggggaaccatgtgacttttgcacagcccaagataggtaagngggatcgagacatgnaagcag

SEQ ID NO: 53770 - DNA, 324 bp, Homo sapiens
  misc_feature 4, 6: n = A,T,C or G
caancntgtgtcttgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggtcacattgcatgcaagtttgctgagctgaaggaaaagattgatcgccgttctggtaaaaagctggaagatggcctaaattcttgaagctggtgatgctgccattggtgatatggtcctgcaagcccatgtgtgttgagagcttctcagactatccacctttg

SEQ ID NO: 53771 - DNA, 350 bp, Homo sapiens
  misc_feature 11, 22, 61, 313: n = A,T,C or G
ccggaatggcntttttcaagtnattcttcttagatttgcagtacctactgaaatttgtgtntttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggtcttcaaatatttcatgtttacattaaaaatttccagagaagcataaaagtattcactttcctgccttgtcatttctggaaagatttgggggagatatttatngcatattaattaataaattgtctactaggaaaattgc

SEQ ID NO: 53772 - DNA, 368 bp, Homo sapiens
  misc_feature 1, 4: n = A,T,C or G
ncgnggctccccagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgctgccgacttgtgtcatgccctacgttggtataatcacatcaagtcttacgaaaaggaaaaggcagcctgccaggagtgaagaaagctttgggcaaatatggcctgccgatgtggaagacactacaggaagtggagctacagatagtaaaga

SEQ ID NO: 53773 - DNA, 400 bp, Homo sapiens
  misc_feature 4, 11, 30, 54, 368, 374: n = A,T,C or G
cgangtggccncaggcgtcaacagcctggncaatttgtacctgcaggcctcctncacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcgagaagccagctgaagatgagtggggtaaaaccccagacgccatgaaagctgcatggcctggagaaaaagctgaaccaaggcccttttggatcttcatgccctgggttctgccgcacggacccccatctctgtgacttcctggagactcacttnctaaangaggaagtgaagcttatcaagaagat

SEQ ID NO: 53774 - DNA, 379 bp, Homo sapiens
  misc_feature 4, 46, 212, 236, 279, 308, 363, 375: n = A,T,C or G
ccgnggattcctgtgtgtttgttgggaattttgtttttagccaggncagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactntttcttaggtttgctaaatactgnagggaaaaaaatgcttctttctactttgttattttaagacttnaaaatgagctacttcttattcacttttgnaaacagctaatagcatgggttccaattttttttaaggtcactttttttggtctanggggaaatgaanggca

SEQ ID NO: 53775 - DNA, 327 bp, Homo sapiens
  misc_feature 4, 33, 41, 295: n = A,T,C or G
acanagaactctctctccttccttccacctgtnagcttctntggttctgagataagaaccattgtgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgngaatgatcttttaaataaaagaaaaccttacg

SEQ ID NO: 53776 - DNA, 120 bp, Homo sapiens
  misc_feature 28, 52, 53, 59, 64, 69: n = A,T,C or G
acaaatgcccttaagatggaaatctttncaatttataagatagctagataanntatggntatgnagtcngcactctggatccatagattatatatccccagattcaaccaactgcagggc

SEQ ID NO: 53777 - DNA, 397 bp, Homo sapiens
  misc_feature 4, 12, 34, 79, 122, 131, 205, 253, 277, 279, 366, 394: n = A,T,C or G
cagnagagtccnagaagagaggagctagctgtgngccctggtacttgaagacgcggttcgggtcgcccctagctgtttnctactcacccaaagccccgcacccgccttttctctctctcctntggcaggangaggcgtgcaggcctgggtgaaggagtacctcctggcaactatgggaactatggctatgctaatagtgggtatngcgcctgtgaagaagataatgagaggctcactgaaagtctgagaagcnaaagtaactgctataaaatctctntncattgaaataggccatgaagttaaaacccagaataaattattagctgaaatggattcacaatttgattccacaactggattctaggnaaaactatgggcaaactggaagatttantca

SEQ ID NO: 53778 - DNA, 395 bp, Homo sapiens
  misc_feature 1, 10, 56, 213, 330, 370, 394: n = A,T,C or G
ncggggtttncgtagtagtggaagattttaggtatgtagagcaagttgaaaatgtnattgagactgcatggtggcataaatgagaaattgcctgtagcatctagtctacttgaaggacgtggagacataaggagagacaaaaacaggtttgtgccataaagtattttttcaaagacaccaagatgtggtaaatgaaaattattagttcacttncctgctgccatgaaactttgccttaagaaggtgctggattccaaggtttgtaaaggcatctcggtaaagactgctttttgaatgcatatgattttgcatcagctagactgagttgantctgaccagacttgatggtttaaagtcggaaccgataaantttaaaaaggagaaaaaataattng

SEQ ID NO: 53779 - DNA, 397 bp, Homo sapiens
  misc_feature 3, 17, 56, 376, 382: n = A,T,C or G
cgnggaaccccggtggnggccacttgcgcagaccagacttcgctcgtactcgtgcncctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctggttaactttgtaagatgcaaagaggttggatcaagtttaaatgactgtgctgccctttcacatcaaagaactactgcaacgaaggcgngcctgnctttccatctgtcta

SEQ ID NO: 53780 - DNA, 162 bp, Homo sapiens
  misc_feature 10, 11, 32, 51, 58, 69: n = A,T,C or G
agtaaacatnnaaaagtagccaggcatggggncgagctgcctgttatcccngctactntggaggctganacagaattgcttgaacccgggaggcagagatagcagtgaactgagatcacaccactgtactccagcctgagtgacaaagtgagactctgtctc

SEQ ID NO: 53781 - DNA, 195 bp, Homo sapiens
  misc_feature 1, 23, 32, 47, 55, 64, 65, 73, 77, 80: n = A,T,C or G
ngggcgagaccaacagaaagganaaggatgcnaaattccggctgaanctaatagngagccgganncaccggtnggcncgntattataagaccaagcgagtcctccctcccaattggaaatatgaatcatctacagcctctgccctggtcgcataaatttgtctgtgtactcaagcaataaaatgattgtttaact

SEQ ID NO: 53782 - DNA, 398 bp, Homo sapiens
  misc_feature 4, 10, 52, 62, 63, 65: n = A,T,C or G
acgncggtgntagagcgttagcatacgtatcaaggacagtaactaccatggntcccgaaganntngccaaaacctcggatgcgtggccttctggccaggcgtctgcgaaatcatatggctgtagcattcgtgctatccctgggggttgcagctttgtataagtttcgtgtggctgatcaaagaaagaaggcataccgcagatttctacagaaactacgatgtcatgaaagattttgaggagatgaggaaggctggtatctttcagagtgtaaagtaatcttggaatataaagaatttcttcaggttgaattacctagaagtttgcactgacttgtgtcctgaactatgacacatgaatatgtggctaagaaataggtcctcttgataaataaaccatt

SEQ ID NO: 53783 - DNA, 317 bp, Homo sapiens
  misc_feature 280, 305, 307: n = A,T,C or G
gcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgnataaatagtatcaataaatatttgngntaatgagacc

SEQ ID NO: 53784 - DNA, 252 bp, Homo sapiens
  misc_feature 4, 24, 42, 53, 62, 82, 98: n = A,T,C or G
atgnccgcatgagggagtgatgantacctattgtaagatatngcaccctatgncattggtgngtcctgatcaagaatttggngtggacgttgccctgnttgctttttataaaccaaactctatctgaaatcccaacaaaaaaaatttaactccatatgtgttcctcttgttctaatcttgtcaaccagtgcaagtgaccgacaaaattccaattatttatttccaaaatgtttggaaacagtataatttgac

SEQ ID NO: 53785 - DNA, 381 bp, Homo sapiens
aaaagctggcaacttctatgtacctgcagaacccaaattggcgtttgtcatcagaatcagaggtatcaatgggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgatcatgagatctatactgtggaaaacgcttcaaagag

SEQ ID NO: 53786 - DNA, 317 bp, Homo sapiens
cattccacaagcattgccttcttattttacttcttttagctgtttaactttgtaagatgcaaagaggttggatcaagtttaaatgactgtgctgcccctttcacatcaaagaactactgacaacgaaggccgcgcctgctttcccatctgtctatctatctggctgacagggaaggaaagaacttgcatgttggtgaaggaagaagtggggtggaagaagtggggtgggacgacagtgaaatctagagtaaaaccaagctgcccaaggtgtcctgcaggctgtaatgcagtttaatcagagtgccattttttttttt

SEQ ID NO: 53787 - DNA, 350 bp, Homo sapiens
aaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgt

SEQ ID NO: 53788 - DNA, 269 bp, Homo sapiens
  misc_feature 97: n = A,T,C or G
catttgcctttaacagcattagtcccgctaagagaaagtttttgcttgtctagtttattacaggtctttgactttgtcagtatatggcaaatttagnataaaagatgattaattatcaaggctgatgaaatataggcagctgaaaagaaaattcttagcaattcataccttagaaggaaccctgaaggacaggacgccatagaaatcctgttttttttaaaaaagtaatttcaagtaagtttgcaaatgcaatgctagtaaaaagtata

SEQ ID NO: 53789 - DNA, 374 bp, Homo sapiens
aaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgggctagggttccactggagaat

SEQ ID NO: 53790 - DNA, 354 bp, Homo sapiens
  misc_feature 37: n = A,T,C or G
atcttcctttataacatttgagagaatcagatgtagngatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgccagtaatgtggttgtaattttgtgtatgttcccccacatcgcccccaacttcggatgtgcggtcaggaggttgaggttcactattaacaaatgtcataaatatctcatagaggtacagtgccaatagatattcaaatgt

SEQ ID NO: 53791 - DNA, 382 bp, Homo sapiens
aatttagcctctttttgacaatgatagctgtggcttgttccaaatcatctgctttgatttgagaagaagcctatttacatatggtacatttaggtgagtggtaacagagaatactttacctgaaaggcctgtgtccttcagacagagcagagtaggagaaaagctagaaagctgcatattccagtcaccacttaggcagaagtcaggaaactggttgttgaaagcaatagaaagtgaaatgagatgacacagggcaatctctgaggttaggtgtgagaggaagggcaggttatgccactaaaaagaggctcttactgacctatatgttataccctgaaacctaaactttttttcattactctctcccctagttctgctgggt

SEQ ID NO: 53792 - DNA, 359 bp, Homo sapiens
atggaatatttagtaacaaataggaacacagtattgatgaacacaccctgaaatgaatctgtaggaaattatggttaaagaaaaagccaatctcaaatgcttatatactgtgtaattccattatgtaacatctcagaattgataaatttatgtaagtggcaacagaataattgattgccatgggtcagggaatggaaatcctgcatcttgctatattaatgtcagtattctggttgtgatattgcaatagttttgtaacatgtcaccactggggggaaactagattaaagatatacacgggcatctgtatattatttcttaaaactgcatgtgacacaattgtctcaatataaaaggtt

SEQ ID NO: 53793 - DNA, 334 bp, Homo sapiens
cagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaat

SEQ ID NO: 53794 - DNA, 329 bp, Homo sapiens
agcttaaggaaagtgtgaaaaaatttttccaatccccacatgaccctgcctgtcttgtaggaggattagggatccactgatgttttggcagggaggtttatagggatgaagttttctgtatttgtatggagtagccaagatatcagtgctagtcagcaaccacccaaccctatgccattcctcaaggtgattaacggtgactgatgaaatcaggttggtgcataacacttcatttttgaagaactgagtagctcatatccaggctgtcagcaaatgcttaccaccagtcttcaaaatatatctggaatcagatcactttttccttcttc

SEQ ID NO: 53795 - DNA, 347 bp, Homo sapiens
gaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgtatttatcaatttttcccagtatttttatacggaaaaaattgtattgaaaacacttagtatgcagttgataagaggaatttggtataattatggtgggtgattatttttataccgatgtgccaaagcttactactgtggaagacaactgttttaataaagga

SEQ ID NO: 53796 - DNA, 331 bp, Homo sapiens
ctaactggtgctgccagctttataatggtggcccacctagccatcaatgtttccaaggcccgcaagaagtacaaagtggagtatcctatcatgtacagcacggaccctgaaaatggcacatcttcaactgcattcagcgagcccaccagaacacgttggaagtgtatcctcccttcttattttttctagctgttggaggtgttaccacccgcgtatagcttctggcctgggcttgcctggattgttggacgagttctttatgcttatggctattacacgggagaacccagcaagcgtagtcgaggagccctggggtccatcgccctcctgg

SEQ ID NO: 53797 - DNA, 376 bp, Homo sapiens
tctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggggggtgaatttccggagccaataaggaaaagcttgaagccaccattaatgaat

SEQ ID NO: 53798 - DNA, 365 bp, Homo sapiens
gaaatgaagaggaatgatcttccagaaacagcagtgattggtcttctgtggacatgtataatgaacgctgttgagtggaacaagaaggaagaacttgttgcagagcaggctctggagcacctgaagcaatatgctcccctgctggccgtgttcagctcccaaggccagtcagagctgatcctcctccagaaggttcaggaatactgctacgacaacatccatttcatgaaagcctttcagaagattgtggtctcttttataaagctgatgttctgagcgaagaagcaatactgaaatggtataaggaagcacatgttgctaaaggcaaaagtgtttttcttgaccagatgaagaaatttgttgag

SEQ ID NO: 53799 - DNA, 340 bp, Homo sapiens
tgatgatataatataaaaagaatatagccttagcagtcagtcaggttaggttcatttctcagctcagctgcctattaacaagtaaacttcggggtttgttagccttgacctttctgagctgttttgtcatcttttacatgacattactattatacacagggttgtgagggttaaaggagattgcacatggaaaacacctagcacaatgcctgatacatagtagggggtgaatttttttcttctatgccacagcttcctcatctgtaaaatgaggattaggtttccttggcctacttcacatatgatatggaagcgtggaatgaaataatatccatgaaag

SEQ ID NO: 53800 - DNA, 325 bp, Homo sapiens
caaaatggcggcagcgatggatgtggataccccgagcggcaccaacagcggcgcggcaagaagcgctttgaagtgaaaaaggcatagaatgtcaagctaaccaggcgtccgctacttcagaagagtgtactgtcgcatggggagtctgtaaccatgcttttcacttccactgcatctctcgctggctcaaaacacgacaggtgtgccattggacaacagagagtgggaattccaaaagtatgggcactaggaaaagacttcttccatcaagctaattgttttgttattcatttaatgactttccctgctgtacctaattacaaat

SEQ ID NO: 53801 - DNA, 350 bp, Homo sapiens
gagtggagagagcgagctgagtggttgtgtggtcgcgtctcgtaaaccggtagcgcttgcagcatggctgaccaactgactgaagagcagattgcagaattcaaagaagctttttcactatttgacaaagatggtgatggaactataacaacaaaggaattgggaactgtaatgagatctcttggcagaatcccacagaagcagagttacaggacatgattaatgaagtagatgctgatggtaatggcacaattgacttccctgaatttctgacaatgatggcaagaaaaatgaaagacacagacagtgaagaagaaattagagaacattccgggggtttgataaggatg

SEQ ID NO: 53802 - DNA, 177 bp, Homo sapiens
  misc_feature 98, 106: n = A,T,C or G
ggaaattgtcatcagaactcacctttgatttccagattgaatcaatagtgtgcctacaagacagtgtgctagctttctggaaacatggaatgcaaggnagaagttntagatctaatgaggtaacacaagaaatttcagatagcacaagaattttcaggctgcttggatctgacaggg

SEQ ID NO: 53803 - DNA, 132 bp, Homo sapiens
  misc_feature 102, 103: n = A,T,C or G
cattggcatgccacaggggattctcctccttcatcctgtaaaggtcaacaataaaaaccaaattatggagctgcttttgtcacactagcatagagaatgtgnngaaatataactttgtaagcttgtatgtgg

SEQ ID NO: 53804 - DNA, 285 bp, Homo sapiens
  misc_feature 124: n = A,T,C or G
atgaaaggacagggatttttgttcttgttgttctcgttgttgttttaagtttactggggaaagtgcatttggccaaatgaaatggtagtcaagcctattgcaacaaagttaggaagtttgttgnttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtg

SEQ ID NO: 53805 - DNA, 361 bp, Homo sapiens
ttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagccctcacctgtgaagtggatgcccttaaaggaaccaatgagtccctg

SEQ ID NO: 53806 - DNA, 357 bp, Homo sapiens
agtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgcaacctttgtaagaaaaccaaaataaaaaattgaaaaataaaaaccataaacatttgcccacttgtggcttttgaatatcctccacaga

SEQ ID NO: 53807 - DNA, 386 bp, Homo sapiens
gagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatg

SEQ ID NO: 53808 - DNA, 201 bp, Homo sapiens
cctgctgctgcccgcagcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggag

SEQ ID NO: 53809 - DNA, 170 bp, Homo sapiens
acacacctgtaattccacctacttgggaggctgaggcatgagaattgcttgaacctgggaggcagatattgcagtgagctgaggtcgtgccactgcactccagcctggacaacagagcgagactccatttcaaaaagatcgaaaaaaaaaaaaaaaaaaaaaaaaaaaaa

SEQ ID NO: 53810 - DNA, 157 bp, Homo sapiens
agagcattccacccaatataataaaacctgttaagaatgtcagtctttgttcaaacatctgtttgttctatctccagtcattaaatcagtgctgctgcatgacacttttaactcctgactttttatatccagtcataaagttgactttcagcacaaa

SEQ ID NO: 53811 - DNA, 312 bp, Homo sapiens
  misc_feature 96: n = A,T,C or G
gacgggcgcggagacgcttctggaaggaacgccgcgatggctgcgcagggagagccccaggtccagttcaaacttgtattggttggtgatggtggnactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatggttgatgta

SEQ ID NO: 53812 - DNA, 362 bp, Homo sapiens
atatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaactcgctgctgcttagatcactgcagcttctaggacccgggttcttttactgg

SEQ ID NO: 53813 - DNA, 387 bp, Homo sapiens
  misc_feature 60: n = A,T,C or G
gggaacgaaaggaagtggaagaaacgcggaaccatggccgctgtggttgctgtttgcggnggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatgggg

SEQ ID NO: 53814 - DNA, 328 bp, Homo sapiens
tgatttgccacctggatgaaggcagacatcaacatgggtcagcacgttgagttacgggagtgggaaattacatgaggcctggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtccttgactgaatattggctttaagaatgatcttatactctgaaggtgagaatatttg

SEQ ID NO: 53815 - DNA, 148 bp, Homo sapiens
actttgatttcaactgccaccaaatgaaaaccatttgttttcctattttaacttggccttttttcttcaattcaaacccagcataactcctcaagtttgttttggggaacttgaataaaatattttctttgatacaaaaaaaaaaaaa

SEQ ID NO: 53816 - DNA, 358 bp, Homo sapiens
gtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggctt

SEQ ID NO: 53817 - DNA, 328 bp, Homo sapiens
agatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttgctctagtatggtgtatttaaataataaaaacttaaaagaaaaaat

SEQ ID NO: 53818 - DNA, 230 bp, Homo sapiens
tatgagaagaaaaagacctcaagaaagcaacgaaaggaacgcaagaacagaatgaagaaagtcagggggactgcaaaggccaatgttggtgctgcaaaaagtgagctggagattggatcacagccgaaggagtaaaggtgctgcaatgatgttagctgtggccactgtggatttttcgcaagaacattaataaactaaaaacttcaaaaaaaaaaaaaaaaaaaaaaaaa

SEQ ID NO: 53819 - DNA, 371 bp, Homo sapiens
ggccgggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttt

SEQ ID NO: 53820 - DNA, 412 bp, Homo sapiens
  misc_feature 329, 344, 347, 358, 359, 369, 370: n = A,T,C or G
agtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagcactcttaattaatatctgnatcctggacaatatntantggtaaggttnnctgggggcannttcataggatccatattttaatactggtaatacctccatgaa

SEQ ID NO: 53821 - DNA, 163 bp, Homo sapiens
tgggtaaaacaccaaacttgaaatcagacataggtgcaaatggccactcctgtagtttcttttctgtaaaatgggatctggcgaatgataccaaacgtttctttctaacattgtattttataactctggcctatgattgtgttgtgtcttgcattaaaaaaaa

SEQ ID NO: 53822 - DNA, 403 bp, Homo sapiens
gatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggttgtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcataggttctctaaaaagaaaacttggggatcatagccgatagagagacttgctaaaatataaatcagcctctgcaaaaaaaaaa

SEQ ID NO: 53823 - DNA, 166 bp, Homo sapiens
agaccccatccttggctgcttgcagggccactgtccaggcaaatgccaggccttgtccccagatgcccagggctcccttgttgcccctaatgctctcagtaaacctgaacacttggaaaaaaaaaaaaaaaaaaaaaaaaaaaaaaaaaaaaaaaaaaaaaaaaaa

SEQ ID NO: 53824 - DNA, 342 bp, Homo sapiens
tgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaa

SEQ ID NO: 53825 - DNA, 343 bp, Homo sapiens
aataaaacagaagcgtttgtgtatataattacctttggatacctgaaattcccaagcttggttacaatgtaatgctcagtataaggctgtgcaaacatgtaagggaataatggtggtccgatgggatatatgaaatgggatctagagggcttcgagtgaagccaatcatgttgaacgaacactggttcagtgtagatgaagtagagtgaggcgtatgcagtcataaaatgaagggtggacaggagattacatttgaagaaaggataagcactcagacttggtctctttaaaattaaaatattctttctcatgtgccaatgtatatcaaagacttgaccaggta

SEQ ID NO: 53826 - DNA, 207 bp, Homo sapiens
actctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggttggacttgggaacaggactttatacctcttttactgtaacaagtactcattaaaggaaattgat

SEQ ID NO: 53827 - DNA, 367 bp, Homo sapiens
acagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgtctgcttcgaagtattcaataccgctcagtattttaaatgaagtgattctaagatttggtttgggatcaataggaaagcatatgccggccaccaagatgcaaatgttttgaaatgatatgacccaaa

SEQ ID NO: 53828 - DNA, 374 bp, Homo sapiens
gcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggttgga

SEQ ID NO: 53829 - DNA, 215 bp, Homo sapiens
tgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttt

SEQ ID NO: 53830 - DNA, 181 bp, Homo sapiens
aggagcaacaccaattttacacaatttcttccagaacacagaagaggaaggaacactttcccacttattttgtgaaactggctctatcctgacaccaaattaaagactagttttaaaatcctactacagaccagtgtctctcctgaacatagaggcaaaaatcctccactaaatacaagcg

SEQ ID NO: 53831 - DNA, 246 bp, Homo sapiens
tggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttaaaaaaaaaaa

SEQ ID NO: 53832 - DNA, 343 bp, Homo sapiens
tttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtggggtttttttttt

SEQ ID NO: 53833 - DNA, 147 bp, Homo sapiens
  misc_feature 11, 15, 50, 54: n = A,T,C or G
atgattaatantatnaatataataatgatgatgatgatgatgaaaactangganttttcaagagatctttctttccaaaacatttctggacagtacctgattgtatttttttttttaaataaaagcacaagtacttttgagtttgtt

SEQ ID NO: 53834 - DNA, 315 bp, Homo sapiens
gctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaaga

SEQ ID NO: 53835 - DNA, 238 bp, Homo sapiens
  misc_feature 232: n = A,T,C or G
ttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaatgtatttaaaanaaaaaa

SEQ ID NO: 53836 - DNA, 371 bp, Homo sapiens
acatcgcccccaacttcggatgtgcggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatctttctaaacttgtgtttaataaactttaatagtcatagaattgtaaatcactatggttaacagaaagtgaaaatattttcatgcagatgatgtgaacagccatgtgaataggtgact

SEQ ID NO: 53837 - DNA, 259 bp, Homo sapiens
ttcaagttccattttcccccagcaccgtgtggcaccttccccagaaccctcacattttttttctaatattcacagggttattgtttgtaaaaaatctatttatttgctttattccatcaagtaatttattttcatgagatttcttggaaatgtggctctacatatcgttagtacaagtaatacattttgattgttgtttcctggaataacttgtattatttgatgagttaaataaaatgcctaattctaaaaaaaaaaa

SEQ ID NO: 53838 - DNA, 381 bp, Homo sapiens
caatcataaaataacagtaaattccaaacctcaaaaactattatggtctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaatttgttgtgtggacttctcatctaaaaggttagtggcttttgcttgggatcagtgctctctattgatgttcttgctggtctccagacacattcctgttgcattaagacttgaaagacttgtagatgtgtga

SEQ ID NO: 53839 - DNA, 301 bp, Homo sapiens
tatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagtctttatgtatttcttattggcattcaacatatgtaaaatcagaaaacagggaaattttcattaaaaatattggtttggaataa

SEQ ID NO: 53840 - DNA, 329 bp, Homo sapiens
  misc_feature 65: n = A,T,C or G
gaacctatttggagactattggactaaaccaggcaaaagatgatggaggattggcctaggttggnagcagtggaagtagtaagaattgttcattttccagatacaatctgaaggtagagcctgcaggatttgctaacactttctatgttggatatgagagtaaagagccaagaaaattccaaggcttttgtcctgaacaattgagcaaatggtggcaccatttgctggagatgagagggaaaaatatggtatgttgggggcaataagggaaggttggggatcaaatgtttgcatttgggcatgttaagttagagatgcctattgtggag

SEQ ID NO: 53841 - DNA, 353 bp, Homo sapiens
acttaactcactttattctcatagttgaggaaaactaatttcatgtaaaaatgcacaacagaaaagaatcaacattaagtgccactcaaagataacaaaaaagagaaataggaacagaataatacctttacaaataaaggtagcattccagaaagatgtgttcacaaaacagagtaaaactaataattacaaaatgagctgaaagatattttaaaaagtatagaagacatgaaccaagaaaaattagaaagctcagaaatgagttgacaactcaggaaaaaattagaaattaaagaaatattattccagaaatgaagactaaattagagggcaaaagagtgaataggctggac

SEQ ID NO: 53842 - DNA, 235 bp, Homo sapiens
atttttaaagtaccttattaattttgttaccttcatagaatcattagctagaatatctgaatatagttgtctcttatatttcttggttcctgtccttagagtcatgttaatagttttaggtcatattcctgtgattttattgtaagctagctcaaatctttttttggaaataggataaaaatcaatctgtacttttttttttgacttgctctgggcaacaacagtgaaactccct

SEQ ID NO: 53843 - DNA, 309 bp, Homo sapiens
aggaaagtcacccaaacacttctgctttcacttaagtgtccggcccgcaatactgtgggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgcgccaaagctttactactgtggaaagaca

SEQ ID NO: 53844 - DNA, 136 bp, Homo sapiens
  misc_feature 14, 62: n = A,T,C or G
caagcggagacggnatggggaaaaatactgattctgtgaaaataccccctttctccattagnggcatgctcattcagctcttatctttatattccagtaagttattttgctctcactgttttaacaaaaaaaaaaa

SEQ ID NO: 53845 - DNA, 244 bp, Homo sapiens
gacccatgaaggcagacaaagagatgtgacttgtagagttgaatttgtggcaaagaaacagtatcacactgtatgtcaacacacaagttttatggaactaaggtgacttcaagaagtggtctgaaagcgaggcatggtggctcatgcctgtaatcccagcattttgggaggccaaggcaggtggattgcttgagcccaggagttcgagaccagcatgggcaacatgacaaaaccctgtctctac

SEQ ID NO: 53846 - DNA, 299 bp, Homo sapiens
aagtgtgggcatattctcctcttttctacaaaggttttcaaatggttcctgaggttttttgttgatgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgtagtgaaaggtagaaattatttcacaaatcagttctctgg

SEQ ID NO: 53847 - DNA, 278 bp, Homo sapiens
  misc_feature 64: n = A,T,C or G
atataaagctaatttttttctagtttcaactccgtcatagttttttttcctttttgtggtgganatgtgaattcaactttctgtgtattgaagtagcaaaaaccatctttacattccaaaagaatccaacatgtgttatttctttgaggcagtgattgtgaaagttgggttttctttttaattccattgaccatttgtgcaataggaattagacataattagtcgctgaaaacattcgcacattgacccatttggaaaaagtgtgctttttttttttt

SEQ ID NO: 53848 - DNA, 389 bp, Homo sapiens
caaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgcattctacagggctctaatgatgtcgaacttgttgctgagggcaacagcaggttcacttacaccgttcttgtagatggctgctctaaaaagacaaatgaatggggaaagacaatcattgaatacaaaacaaataagccatcacgcctgccctttcttgatattgcacctttggacatcgg

SEQ ID NO: 53849 - DNA, 322 bp, Homo sapiens
ggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttctt

SEQ ID NO: 53850 - DNA, 325 bp, Homo sapiens
ttgcacgctctttaagagtctgcactggaggaactcctgccattaccagctcccttcttgcagaagggagggggaaacatacatttattcatgccagtctgttgcatgcaggcttttttggctcctaccttgcaacaaaataattgcaccaactccttagtgccgattccgcccacagagagtcctggagccacagcttttttgctttgcattgtaggagaaggactaagtgctagagactatgtcgctttcctgagctaccgagagcgctcgggaactggaatcaactgctcagggaaaaaaaaaaaaaaaaaaaaaaaaaaaa

SEQ ID NO: 53851 - DNA, 400 bp, Homo sapiens
tcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacggtaatagcaaaaatcctacctactcagaatcatcttcttaggtggctcctaaatctga

SEQ ID NO: 53852 - DNA, 213 bp, Homo sapiens
ccaagtcagtacaaacaagaaaagttgggtcaagggaggatggaggctcccagctggtctgttctgcaaaggtctggagatgaggaaaagtacccagatgccgtgtacctctcggaggggccctcctcctgctccatggggatccgcagcgcagccggccagggtttgaattagtcattgtttggaggatacaaatagatgaagatgggaagg

SEQ ID NO: 53853 - DNA, 373 bp, Homo sapiens
atggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtacatcagctgtgtaaatagagcaagaaaacagtattctgcatctgtggcatttatgtagagttgcagttgtgtactgctgaaaatgcagcttttgtaacagtgtgatctttactgatgcactcatgacaagtacccaatgtatttagctattt

SEQ ID NO: 53854 - DNA, 296 bp, Homo sapiens
aagggcaagattcttgccaagagaattaatgtgcgtattgagcacattaagcactctaagagccgagatagcttcctgaaacgcgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacagaaaaaaaaaaaaa

SEQ ID NO: 53855 - DNA, 343 bp, Homo sapiens
  misc_feature 34, 49: n = A,T,C or G
agttccaagtgccataagtgtatgtacatatagntaataatgacactgntcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagtctttttgaaagaataacaaaataaaatgcaggatctttgc

SEQ ID NO: 53856 - DNA, 102 bp, Homo sapiens
tctttctggcctggaggctatccagcgtactccaaagattcaggtttactcacgtcatccagcagagaatggaaagtcaaatttcctgaattgctatgtgtc

SEQ ID NO: 53857 - DNA, 271 bp, Homo sapiens
  misc_feature 13: n = A,T,C or G
tcatgcaagtgtnttcctggaaaaagaacaaatgcactgtggtaaaattcaagtgcattcctatacttaaaattcaacagatctaaagatagtaattcagagcaaaaggaaattaaaatatttgagcagtttctttgtgacacctgaaaacaagtgccaggggatttatgagttattatctctagaataggtcgcttcatgggcctgtagcctgccatcactcagggacccatgctgagaagcctctgctcttgggcaaatgctctgccct

SEQ ID NO: 53858 - DNA, 353 bp, Homo sapiens
ttcactctgcttctagcattggacagatcatccagagtatcaacaaggaaacactgggcttaatctgcactatagaacaaatgtacttaatagatatttacagaacatttcatccagtggctgtagaatacactttttcctcagcatatggatcattctcaaggatagaccgtatgttaggtcacaaaacacgtcttaaaactttcaaaaacaatgaaataatatcaagcatgttctctgacaacaatggaataaaactagaaatcaataataagaggactgtagaaactatacaaacacatggaaattaaacaatatgctcctaaatggctattgagtcaatgaataaggaa

SEQ ID NO: 53859 - DNA, 397 bp, Homo sapiens
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagggaccagctctgtgaacacggcaagtaacaacagagagaaaacgtgaggagaaaagagagaccgggattttgaaatcctgtttcctgaatgccatctcaccaggcacacgaaagaataaaattaaggatccgga

SEQ ID NO: 53860 - DNA, 360 bp, Homo sapiens
caacctagtcacagagcagcacctaccccctcctcctttccacacctgcaaactcttttacttgggctgaatatttagtgtaattacatctcagctttgagggctcctatggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagtcctgatgaccgcgacttcgagccctccctaggcccagtgtgccccttccgctgcaatgccatcttcgagtggtccag

SEQ ID NO: 53861 - DNA, 345 bp, Homo sapiens
tgggattcttagtagtatgtttttttcttgaaactcagtggctctatctaaccttactatctcctcactctttctctaagactagactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtaga

SEQ ID NO: 53862 - DNA, 228 bp, Homo sapiens
gaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgcaatatttttctgtattttgtttataattttattttttaaataaaaagtgtataaaaat

SEQ ID NO: 53863 - DNA, 179 bp, Homo sapiens
  misc_feature 11, 62: n = A,T,C or G
taaaacagcanagtacaagatgcatttttgtatttattctaacttttgaacattagtgtctntcagtataaataaatgtgaacaaatatacctcagtagtaatacaggagaactaaatatcctgctataacttaatacagatacatatttcaatatgacttaacaaacacacaatttta

SEQ ID NO: 53864 - DNA, 317 bp, Homo sapiens
  misc_feature 45: n = A,T,C or G
gtggcctgaagcatttactggacaaagtaatgttactctaatggntacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctggcctgaacagggaggtggtcgctcaggcctggtgctcagtcgtacgacctgtacctctcaacttttgccctatctggtaaatatatgctatgcattaaatgcttttaaatct

SEQ ID NO: 53865 - DNA, 284 bp, Homo sapiens
ggagaccctaacttggaatttgttgccatgcctgctctcgccccaccataagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagccgtgtgtgccacctcattattatctagctaagcggaacatgtgcttcatctgtgggatgctgaaggaga

SEQ ID NO: 53866 - DNA, 386 bp, Homo sapiens
  misc_feature 1, 19, 29, 38, 71, 87, 125, 253, 352, 362: n = A,T,C or G
naacaggagaatatgtcanataccacctnaaggtgcantcacagcaaaatccgactgtaggaaattctccnggacaaatgacccagnttctacaattaataaattgcaagggaaaaaactaggangggagaggaaacctatagtttatatggaagagacagcaaccagttgtaatgtatagtccttactggatcttgattcgaacaaacttaaaaaataagaccatcagagaaatttgaacattgactaaggnttttttaaacgatataaaaaaactattggtaactatttctggctgcagaagtggtgttaacaggtataattttaaatacaccttttagagatgcctacngaaatatttncagataaaaatgagatgatgcctg

SEQ ID NO: 53867 - DNA, 390 bp, Homo sapiens
  misc_feature 184, 316, 330: n = A,T,C or G
tgtcccatggaacctgccctctaaagcactttctttcccttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtggggncatttttaattagattctttcccctgctgagttggaaattccagtgcagcactgattgccacagttgccaatctaaaagcacaaagcagaagtaaagctttatgctaattttatttcaatatgatagaaaanttatcttgggatgnccttttttagataactccagcaggaaactgtactgctatgctttaggaaaatgtaagaag

SEQ ID NO: 53868 - DNA, 219 bp, Homo sapiens
  misc_feature 3, 17, 32, 33, 48, 67, 104: n = A,T,C or G
agngccctgtcctgtangtatttacaataagnntctaaccttgcctgntacaagtacgtggggctgnaaattggcatggaaatttaaagcaggttcttgttggngcacagcacaaattaagttatatatggggatggtagttttttcatcttcagttgctctgatgcagcttatacgaaataattgttgtctgttaactgaataccactctgtaattgc

SEQ ID NO: 53869 - DNA, 244 bp, Homo sapiens
  misc_feature 1, 4, 38, 41, 61: n = A,T,C or G
ncgngggtgccctaaataaaaacacttcatacctaganttngggggatctagattctagtntagacatcactgcttactgtaagatttaagtcccattatttatttttcagtttcctaaattataacaataggcatagctgctacacctgcctcacatgaaagtgctttttttttaatgttaattttaattttatttttgagacagggttttgctccagtctgtgcgacagagcgagactccat

SEQ ID NO: 53870 - DNA, 398 bp, Homo sapiens
  misc_feature 1, 4, 55: n = A,T,C or G
ncgnggaacccccctcaaatgaaacccagtggaaagagcttactcagtattttgnagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaacttgcatgggggtttgaagcaaagaagagatgggaaccaaaagcacatgggatacttgtaacttgccagagtgcttcaagacatttgtagactcaaatgctcaatttac

SEQ ID NO: 53871 - DNA, 263 bp, Homo sapiens
  misc_feature 5, 29, 42, 83, 231: n = A,T,C or G
ggacncagaaaaaggatatattgatttgncaaaaagaagagnttctccataggaagcaatcaaatgtgaagacaaattcacanaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatntaagcatgcagtctcagacccatctattttgg

SEQ ID NO: 53872 - DNA, 393 bp, Homo sapiens
  misc_feature 4, 5, 29, 50, 369: n = A,T,C or G
gatnncgaagacgattaagggaaggtcgntctcagtggaaaatccaaaanccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgcaccagattcattacaattcaaatcgaagagttgngaactggtatcccattgaaaagac

SEQ ID NO: 53873 - DNA, 229 bp, Homo sapiens
  misc_feature 13, 87, 131, 169, 196: n = A,T,C or G
ggccgggggatcnactacctgattttccctacaaagatgacctcctggccttggactccagctgcctcctgttcattgttcttgtgntctttgccttattcatcatttttaaggcttatctaattaactgnggttggaactgctataaatacatcaacaaccgaaacgngccggagattgctgggtaccctgcctntgaagcacctcctcaggacgttttgccaaccta

SEQ ID NO: 53874 - DNA, 239 bp, Homo sapiens
  misc_feature 41, 42, 51, 61: n = A,T,C or G
atctccatacattcaaatttgtctggttaaaaaataggtgnntagatattnaggccaagantattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatg

SEQ ID NO: 53875 - DNA, 142 bp, Homo sapiens
  misc_feature 2, 14: n = A,T,C or G
tngaattgctcagncttgccagcaagcaatcatttggggaagaatctacagttgctgatggacagagtggatgaaatgagccaagatatagttaaatacaacacatacatgaggaatactagtaaacaacagcagcagaaac

SEQ ID NO: 53876 - DNA, 164 bp, Homo sapiens
  misc_feature 4, 61, 83, 102, 105: n = A,T,C or G
aaanccaaagaattacggcttttacagcaacaatacgattatcttataggaaaaaaaaaancattgtaaagtatcaagacaanacgagtaaatgaaaaggcngtnaaagtaggatgacatcatgtgttagcctgttcctaatcccctagaattggaatgtgggg

SEQ ID NO: 53877 - DNA, 393 bp, Homo sapiens
  misc_feature 5, 21, 26, 376: n = A,T,C or G
agatncactcggacctcaagnctcanctcagggagctgaatattacggctgctaaggaaattgaagttggtggtggtcgggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgcagctgtgcacgatgccatccttgaggacttggcttcccaagcgaaattgtgggcaagaagaatccgcgtcaaactagatggcagccggctcataaaggntcatttggacaaagcca

SEQ ID NO: 53878 - DNA, 193 bp, Homo sapiens
  misc_feature 5, 6, 36: n = A,T,C or G
agtannagactggttaatgataacaatgcatcgtanaaccttcagaaggtaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtc

SEQ ID NO: 53879 - DNA, 190 bp, Homo sapiens
  misc_feature 5, 6: n = A,T,C or G
tgcannaattatcaaaatagaaaaaaccaaacagtatacaactaaaagtatgaacaaaagtataatcaagaaaaagagggaggcaggcacagtggcttatgcctgtaatctcagcactttgggaggctgatgcaggaggatcacttgggcccaggaatttgagaccagcctggcaaaacaccatctctac

SEQ ID NO: 53880 - DNA, 391 bp, Homo sapiens
  misc_feature 5, 50: n = A,T,C or G
atttncagagacattagatattggctccaaacttcttccagtctccaganaaaacaaaaagccatcacagaccacagggtcagagttagggcttatggaagttagaagacagatggagctttggccttagttcatctcacaataatattagtgggactacagaactttcctgtagttactacccccgaaattcatactgagaacagatacacttagcgactggcagaatcctgcattcattccagcaccagtggaataatagttaattttgtgggaaggccagaaggatgtccgaagaactaaccttcacccacatcactaacaaagtaaactaaaaatcagccctgtgtcctgggggtattgcagagattattgccattttcaaagattc

SEQ ID NO: 53881 - DNA, 268 bp, Homo sapiens
  misc_feature 3, 10, 44: n = A,T,C or G
ganagccctnatttttataacctggcaaaatcttgttaatgtcnttgctaaaaaataaataaaagctagatactgggaaacctaactgcaatgtggatgttttacccacatgacttattatgcataaagccaaatttccagtttaagtaattgtctacaataaaaagaagttttgcctgccattttcagaatcatcttttgaagctttctgttgatgttaactgagctactagagatattcttatttcactaaatgtaaaatttggag

SEQ ID NO: 53882 - DNA, 384 bp, Homo sapiens
  misc_feature 271, 286, 333: n = A,T,C or G
gattcctgaagctgacagcattcgggccgagatgtctcgctccgtggccttagctgtgctcgcgctactctctctttctggctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggnctttctatctcttgnactacactgaattcacccccactgaaaaagatgagtatgcctgccgngtgaaccatgtgactttgcacaagcccaagatagttaagtgggatcgagac

SEQ ID NO: 53883 - DNA, 379 bp, Homo sapiens
  misc_feature 2, 5, 50, 52, 152: n = A,T,C or G
gnttncacaggagaagcaagcaggcgaatcgtaatgaggcgtgccgccgncnatatgcactgtacattccacaagcattgccttcttattttacttcttttagctgtttaactttgtaagatgcaaagaggttggatcaagtttaaatgacngtgctgcccctttcacatcaaagaactactgacaacgaaggccgcgcctgcctttcccatctgtctatctatctggctgcagggaaggaaagaacttgcatgttggtgaaggaagaagtggggtggaagaagtggggtgggacgacagtgaaatctagagtaaaaccaagctgcccaaggtgcctgcagctgtaatgcagttaatcagagtgccatttttttttttg

SEQ ID NO: 53884 - DNA, 397 bp, Homo sapiens
  misc_feature 261, 305, 360, 394: n = A,T,C or G
cgggacagccgcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttaagaaatttgcaagggcttcttttccgcaaatgccaccagcagattataattttgcagcaatgctatnatctctaattagtgccaccagactagacctgtatcattcatggnataaattttactcttgcaacataactaccatctctctcttaaaacgagatcaggntagcaaacgatgtaaaagaagctttattgctagntgt

SEQ ID NO: 53885 - DNA, 319 bp, Homo sapiens
  misc_feature 19, 39, 290: n = A,T,C or G
gtccaggcagattcttgtngaagttgcttttgcatgtgnggtattctcaacattagttttttgaggggcacttgtgaatattgaggttatatgagaactttgagtatgggaatgattttcactgtggtttctgactttgttttggaggtgtggcatgcagcattttggaaggaaaattgaagacgtgtcaagaaaacatgaacagaagcaaatgatgaaaatgagcattttacttgatggtgataacatcacaataaattatggagaaaaatcatatttggctaactttnaattgctgaacaataaagggtttcctttt

SEQ ID NO: 53886 - DNA, 176 bp, Homo sapiens
  misc_feature 14, 23, 34, 46: n = A,T,C or G
ccgaggctgccgantatgctaancttttggccangagaatgaagtnggctaaggagaagcgccaggaacaaattgcgaagagacgcagactttcctctctgcgagcttctacttctaagtctgaatccagtcagaaataagattttttgagtaacaaataaataagatcagactca

SEQ ID NO: 53887 - DNA, 195 bp, Homo sapiens
  misc_feature 2, 3, 29: n = A,T,C or G
anngcctgggccttgtggataatgtacangatttaaaaacaaatcttgttgctgatttgtccatttctttccctgcactttgttacatctgggatacaagtctaactcatctgatttaatatgcatttaaaaaaatgccataactattaaacaccttgtttacagacagatgaaataaatttattccaaccagtt

SEQ ID NO: 53888 - DNA, 358 bp, Homo sapiens
  misc_feature 41, 48, 49, 51, 73, 149, 166: n = A,T,C or G
gagtcccataagattgagggcagagttgaattatcctgaanaagctanntncaactttagaagtttataaaantgagagatcacttcagtgatctagctgtcataacaacagaaagtttaaaaggatgcagtgtcctgacagatgaggnagacatacacgtgtggnagagtaagggttggtaatctaatggaaaacgaagacatggaactattgggaaagtgagaacagtctgctagactagggcattatgagaacaaagctggatggtacagaccttcaaggaggattcagaaagccaggtaaaagagcagcagggaaagaagccactacttatggtcttgaataagacagttattt

SEQ ID NO: 53889 - DNA, 265 bp, Homo sapiens
  misc_feature 5, 10, 32, 38, 55, 58, 65: n = A,T,C or G
ccggngcttncaccaaattatcttgatacatncaaatntggctggataaaaaatnggngggaganattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatccct

SEQ ID NO: 53890 - DNA, 377 bp, Homo sapiens
  misc_feature 4, 7: n = A,T,C or G
ccgnggntgccagatgtactaactcattcttccccaggcagagaggagtaagctgaggcagcaacattcctcatcacagcaaggctcgaggtctctgcagagatgagtgggagagcctgctgtgtctgtggccatgccatcatggttggctgcccctgcccaaacagaacaacaacagatagtgggcttggcctcaaggctttgggtgaccaggcaggcaaggagctaaggctcactggttttagaaaatttgtcaaggccggcatggtgctcacacttgtaatcccagcactttgggaggccgaagtggcagatcacaaggtcaggagatcgagaccatgctgctaacatgatgaaaccccgtctctactaaaaat

SEQ ID NO: 53891 - DNA, 148 bp, Homo sapiens
  misc_feature 3, 30, 49, 51, 69, 74, 75, 83, 87, 90, 98, 107, 132, 142,144: n = A,T,C or G
aanagaaagtaccatcaaagactgtggagncattgagggtctgtgtgtncncaccgagagggacctggngtgcnngccgggtngatnttnccacgtgntaagggttnatatttatacaacacatcttttganactttaaggngngggg

SEQ ID NO: 53892 - DNA, 269 bp, Homo sapiens
  misc_feature 4, 49, 51: n = A,T,C or G
gggnccacatagacagaatatagaggaaaagggtttaggacaagtctgncnttcatctgtttcttattcattgaattttagaatctatttaccagggcggcacttactgtcttttttaataactggtcctttgcatacatttgtaaaagtctattaaaaaataagtctcagccggcacatcccagcacttggggaggctgaggcagcagatcatgaggttaggagtttgagaccagtctgaccaatgtggtgaaaccccgtctttacta

SEQ ID NO: 53893 - DNA, 320 bp, Homo sapiens
  misc_feature 3, 42: n = A,T,C or G
ctncgtggccttagctgtgctcgcgctactctctctttctgncctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgaagtatgcctgccgtgtgaaccatgtgactttgcacaag

SEQ ID NO: 53894 - DNA, 358 bp, Homo sapiens
gcaaccgaggagtgaggagtgctgctgtaagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggtaatctcagatgcagtttggagagtcagatctttctccttgaatatctttcgataaacaacaaggtggtgtgatcttaatatatttgaaaaaaacttcattctcgtgagcatttaaatgtgacaatgtacacactggtacttagagttctgtttgatctttttaataactactctttg

SEQ ID NO: 53895 - DNA, 133 bp, Homo sapiens
  misc_feature 11: n = A,T,C or G
gaagccacgantttctttaacatatcattcagaatgtgcaaagctgtatttacaggctgagacacagcccagagactgaacggcaatctttccacactgtggaacaatgcatttgtgcctaaacttcttttgg

SEQ ID NO: 53896 - DNA, 375 bp, Homo sapiens
  misc_feature 15, 156, 196, 199, 211, 260, 317, 322, 342, 370: n = A,T,C or G
agctcccgataattntcaccaagtgaaacacacttatgcaactaagactcagaacaggaaggaaaacattaatggaacctcagaagtccttcatgctcctttctaacagtcacttatctaacactgtacattagttgtgcccattattgaaaactngtgtatgaattgaaacatacaatttgtaccttcttttggnggnggggaaggtctnttgctcagtttcacatgtgttattgcagaatattaattcattggtttgnactattccactggttggatataacacaatttattcattcttcacttaatggataggntgggnttctggttgggcaataatgnaccacagtactatagacatcttatgggnccctg

SEQ ID NO: 53897 - DNA, 393 bp, Homo sapiens
  misc_feature 15, 50, 130, 262, 321, 333: n = A,T,C or G
aacaccagaaatgcnaataccttcatatcccctcagcagagatggagagntaaagtccaagaagaggatccgagaacgctctaagcctgtccacgagctcaatagggaagcctgtgatgactacagactntgcgaacgctacgccatggtttatggatacaatgctgcctataatcgctacttcaggaagcgccgagggaccaaatgagactgagggaagaaaaaaaatctctttttttctggaggctgcacctgattttgnatccccctgtagcagcattactgaaatacataggcttatatacaatgcttctttcctgnatattctcttgnctggctgcacccctttttcccgccccagattgataaagtaatgaaagtgccctgcagtga

SEQ ID NO: 53898 - DNA, 318 bp, Homo sapiens
  misc_feature 1, 4, 90, 178, 186, 194: n = A,T,C or G
ncgngggcaccctattccagtatcacccagggtgcagccacaccaggactgtgttgaagggtgttctttttcttttaaatgtaatacctnctcatcttttcttcttacacagtgtctgagaacatttacattatagataagtagtacatggtggataacttctacttttaggaggacnactctctnctgacagncctagactggtcttctacactaagacaccatgaaggagtatgtgctcctattattcctggctttggctctgccaaacccttctttagcccttcacacatcgcactgaagaatatgatgctgaag

SEQ ID NO: 53899 - DNA, 216 bp, Homo sapiens
  misc_feature 3, 11: n = A,T,C or G
cangaaaatgngtcacatctataccaaattgaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattt

SEQ ID NO: 53900 - DNA, 241 bp, Homo sapiens
  misc_feature 4, 15, 34, 48, 240: n = A,T,C or G
tatncacattctatnaacatattactgtatttgnagttatgcaggtanccactgaaaaactaagaacagaaatgcttcaaactggttgcctctggaaagagagctgggaggaagagtgggctgggagagaccagctctcctcatgcttagccgtgcagtgcaatgtagtattttaccttgtgcatggattttgtaataagaaatagcgatgtgcatttggatattaaaaacattacacanc

SEQ ID NO: 53901 - DNA, 393 bp, Homo sapiens
  misc_feature 6, 181, 282, 285, 360, 367: n = A,T,C or G
gtagcnatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgnacttttggttatgcaaacactttgataatataaacagttatgtcccctataaatctggcagcaacctcttttgattttggtgggtaaggtaaatagtctgnagnaggtagaagactgggacaagtggccaactaagataagagactaaaataaaatgctaaatcttaaaagaactgggnttatgcnctaacgtttgggccttgggctaatat

SEQ ID NO: 53902 - DNA, 292 bp, Homo sapiens
  misc_feature 5, 28, 84: n = A,T,C or G
ggatnccggaggactaactgtacaaatngtggcagcgctttcaacagcttaatataagaactggcctgaatctgtgtatttttncaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagaccggcttatcaagacaaaggt

SEQ ID NO: 53903 - DNA, 398 bp, Homo sapiens
  misc_feature 14, 15, 48: n = A,T,C or G
aggccttgaggcanntagcgcaggggcttctgctgagggggcaggcgnagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggggacttaacagcttaaag

SEQ ID NO: 53904 - DNA, 398 bp, Homo sapiens
  misc_feature 1, 4, 50, 54: n = A,T,C or G
ncgncatgccagctgctaaatagcctagtctggggagtcttccataaagntttncatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcaagtttttggaaagcagggtcctctgcctgctaacaagcccacgtggccaagctgaatgctttcctttacacctatgttttaagtagtcaaacttcaagaaacaatctaaacaagtttctgtgcatatgggttggggaacctggatttggattaagaaggctt

SEQ ID NO: 53905 - DNA, 349 bp, Homo sapiens
  misc_feature 12: n = A,T,C or G
aaggccggtggnccaaaaagagtgctgaatttttgctgcacatgcttaataaacgcagagagtaatgctgaacttaagggtttagacgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaagg

SEQ ID NO: 53906 - DNA, 336 bp, Homo sapiens
  misc_feature 335: n = A,T,C or G
gagaccaatcttaagatagagaaaaaagaagctgatgcaccaaaaaagataagaggagagcattagcatagtggtgcaggggctggaaccagcaccatgtgtttgtggaaacaaggaagacaggattatcagtcagcttctggaaggtatgttggaaagggtttcacaaatgtaaaagaggttattgataaatgggaagtatatacaccatatatttaaatacaatgtatttttattaagcagtgacctctttaaatgtaaagaatgtgtgctttctgacaaaggttgaatatccagcatcataaggaacttaaatttacaagaaacaaaacccnt

SEQ ID NO: 53907 - DNA, 167 bp, Homo sapiens
  misc_feature 6, 21, 44: n = A,T,C or G
agaaanttgctttcattgttntatttcttaattgctatgcttcngaatcaatttgtgttttatgccctttcccccagtattgtagagcaagtcttgtgttaaaagcccagtgtgacagtgtcatgatgtagtagtgtcttactggttttttaataaatccttttgtg

SEQ ID NO: 53908 - DNA, 363 bp, Homo sapiens
  misc_feature 244, 354: n = A,T,C or G
ccgaaggggccagagagcttaagtgaaggcagtttttatggcgttttgtagtatattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggngatacttcttgcttctcatgatgcatgtttctgtatgttaatgacttggtgggtactattaaggactagagttgataaatgggacagggtccttttgcaataaaactggntatgacttg

SEQ ID NO: 53909 - DNA, 100 bp, Homo sapiens
  misc_feature 5, 7, 87, 94, 96: n = A,T,C or G
aacancnacatcaaagatcactgatcacagatcattataacaaagatcactgattacagattaccattgttattgttcaataacaantaaaatntngaaa

SEQ ID NO: 53910 - DNA, 208 bp, Homo sapiens
  misc_feature 9, 26, 45, 55: n = A,T,C or G
ccgaggatncctacaaaaacagattnttgttttaattagctggcntcatggtgcncctatagttctagctactctggaggctgaggcaggaggattgcttgagaaggaagcagtctttctggaggattgctccagaaggtcaaggctgcagtgagctatgattgtgccaccgcactccagcctgggtgacagaaggaggctctatttc

SEQ ID NO: 53911 - DNA, 155 bp, Homo sapiens
  misc_feature 1, 19, 38, 39, 63, 118: n = A,T,C or G
ngaccttgaaaagaagganctgttgcaaagagtagaanntcccttctctcccttgtcacaggnttaaaaacctcacagcttgtataatgtaaccatttggggtccgcttttaacttgnactagtgtaactccttcatgcaataaactgaaaagag

SEQ ID NO: 53912 - DNA, 400 bp, Homo sapiens
  misc_feature 2, 12, 360, 380: n = A,T,C or G
cngcagaacttnagagacaggtatgagtaatctcataaatatgatcaccttaaaaaaatgctgaactagtagactaaataggagctgacagcttctgaatgctgtaaaaattaaaaattactttccagagaaagactttacttagcttaaagattacctttatagaactactgttacccccacttttatagaatatatatatattttttgagatggagtctggctgtgttgcccaggctggagtgcaatggcgtgatctcggcttactgcagcctctgccttctgggtcgggagattctcctgctcagcctcccgagtaattgggattacagcgtgcccaccacaactggctaattttgnatttttaggagagacaaggntttgccatgttgggcaggct

SEQ ID NO: 53913 - DNA, 393 bp, Homo sapiens
  misc_feature 22, 29, 48, 118, 310, 352, 357, 383: n = A,T,C or G
agggcctttttttcttgagaangttactngcaatcatgtttgtagttngcacagacttttatgcataattcactttaaaaatatagaatatatggtctaatagttttttaaagctttnggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggctttagagatttttttttaaggtcaggccgnaggttcctcaaggaatctcttaagttttgcccaaagactggnacttnctttcagtagggcgctaatggatacncattaatgat

SEQ ID NO: 53914 - DNA, 344 bp, Homo sapiens
  misc_feature 2, 4: n = A,T,C or G
gncntccccggcggtgacgacctacgcacacgagaacatgcctctcgcataggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 53915 - DNA, 328 bp, Homo sapiens
  misc_feature 4: n = A,T,C or G
ccgngagacctgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtga

SEQ ID NO: 53916 - DNA, 284 bp, Homo sapiens
  misc_feature 2, 9, 51: n = A,T,C or G
gnttaccgncattgctaaaaaataaataaaagctagatactggaaacctanctgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaga

SEQ ID NO: 53917 - DNA, 398 bp, Homo sapiens
  misc_feature 1, 8, 49, 374: n = A,T,C or G
nacccctnggtggtggccacttgcgcagaccagacttcgctcgtactcntgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgcaacgaaggccgngcctgcctttcccatctgctatct

SEQ ID NO: 53918 - DNA, 323 bp, Homo sapiens
  misc_feature 41, 49, 103, 266, 277: n = A,T,C or G
tatccattacaaatgagtagtactccactttataaaaaganagaacttnaccaactagaagacaaatatgacaaagactacctcagtggtgaactgggtaganaatctgaagatgaaaatccaggttttgcttcattaattcaccatccagagaccaaataattaaaagaaaaacaaatatagataggtagaactatattttcccccaatcagaatcatcatatcatagggcaatctttcaccaagtaaatttgtataaataagcnctattctttgnattaccaaagcaagggtacaggtgactaccctagtcaaaacaacca

SEQ ID NO: 53919 - DNA, 400 bp, Homo sapiens
  misc_feature 4, 7, 35: n = A,T,C or G
agtntancgtttcagccccagaaaggtacctttcncaatgtaaatgcagagtatctggttagacatagccattttgctcacaagcacattcagagatgaagacatgcagtctctaattgtttcgttgtatctaagagggtgaaaatagaggtggcatatgaaaaaaaccttccattttcattgagcgtacccatattctatggcatttcttaccagtcagtaggaattttttttcctactgatcagtactactgaattacccaaaggcaaaaatattccctattggttctttggtttctaactttggtctctagctctaggtagatgttaactttttggtatttaaatgtgcacctccctgagaccaaactgcctcagcaagtttacttcaatattaatg

SEQ ID NO: 53920 - DNA, 206 bp, Homo sapiens
  misc_feature 2, 10, 41, 43: n = A,T,C or G
anggagaaantcaggaattgctgagaaatgcattttcacantnatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgact

SEQ ID NO: 53921 - DNA, 140 bp, Homo sapiens
  misc_feature 5, 12, 55: n = A,T,C or G
ccganatctccnagatgctgttattgtgaactcgatgagtagggcgggacacgtnttatcctgtctgaatatggggggaccatcctccaaggctaaatactgattgaccgatagtgaaccagtaccgtgagggaaaggcg

SEQ ID NO: 53922 - DNA, 342 bp, Homo sapiens
  misc_feature 11, 18, 44: n = A,T,C or G
gagccatttgntcctgcncatgctttggaggccaagcggggctngcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagcccttgctctggagg

SEQ ID NO: 53923 - DNA, 366 bp, Homo sapiens
  misc_feature 4, 10, 56, 354: n = A,T,C or G
ccgnggactncgataggaatcatgtctggtcgcggcaaaggcggaaaaggcttgtnggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggccgcactctgtatggcttcgcggctgaatctaagaatacgcggtctnctgagaacttca

SEQ ID NO: 53924 - DNA, 397 bp, Homo sapiens
  misc_feature 3, 4, 29, 54: n = A,T,C or G
cgnnaagaccaggaaataaagagcatcgnaataagaaaaaaggaagtcaaactnttcctgtttgcagatgatgattttacacctagaaaatcccatagtctctgatcaaaagttccttcagctgataagcaaagtttcaggatataaaatcaatgtacaaaaatcactagcattcctgtgtaccaatacccaagctgagagccaaatcaagaatgcaacccactcacaatagccacaataaagaataaaatatctaggaatacagctaactagggaggtgaaagctctctacaagaattacaaaacacagctcaaataaatcagagatgacacgaacaaatggaaaaacattccatgctcatggataagaagaatcaatatcattaaaatggcccac

SEQ ID NO: 53925 - DNA, 332 bp, Homo sapiens
  misc_feature 6, 14, 43: n = A,T,C or G
gtaaanttacatgnactaacataggaagaagtctatgagtgtnaaaagcaaggcaaagaataggatgtgtaaatatgtgtatgtatttaattgtctaataagtatctcacagaaacattctagtaggacaccaaactgttaagaggggggttagttacctctggtgagtgaggttttactttataatcctatacttcaatgttactttaaacattaaaaaaaattaaaagctaacatgaaggaagttagagtaaactcagtttcacttttaacctctgattctgaagttttaaggaggaaacagctaaccaaagtagtttgctagtaaacac

SEQ ID NO: 53926 - DNA, 327 bp, Homo sapiens
  misc_feature 6, 318, 324: n = A,T,C or G
ggggcntgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttttaaataaaagcncaagtnctt

SEQ ID NO: 53927 - DNA, 381 bp, Homo sapiens
  misc_feature 5, 9, 35, 131, 359: n = A,T,C or G
agagngtanactactgtattgaccccaaccaaggntgcacctttggacgccatgaaggttttctgcaacatggagactggcgagacttgcgtctaccccaatccagcaaacgttcccaagaagaactggtnggagcagtaagagcaaggagaagaaacacatctggtttggagaaaccatcaatggtggcttcatttcagctatggagatgacaatctggctcccaacactgccaacgtccagatgaccttcctacgcctgcttgtccacggaaggctccagaacatcacctaccactgcaagaacagcattgctatctggacgaagcagctggcaacctcaagaaggccctgctcatncagggctcaatgacgtggagat

SEQ ID NO: 53928 - DNA, 274 bp, Homo sapiens
  misc_feature 3: n = A,T,C or G
gangatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattt

SEQ ID NO: 53929 - DNA, 287 bp, Homo sapiens
aactccaggaatatctatttgatctttttattggggaatagaaaggattattatttctgaagtattctatctttccattgaggaatatgacacatatctatatttgttcatgcattcctttttgtcctggagaaaaatttggcagttctcttgatttcaatagaaataccacttagcggtggctcacgcctgtaatcccaacacttgggaaggcccaggcaggtggatcacctgaggtcaggagttcaagaccagcctggccaacacggtgaaaccctatctctact

SEQ ID NO: 53930 - DNA, 311 bp, Homo sapiens
  misc_feature 4, 10: n = A,T,C or G
ccgnggactnccaacctgaaaaaggctgtcattctacagggctctaatgatgttgaacttgttgctgagggcaacagcaggttcacttacactgttcttgtagatggctgctctaaaagacaaatgaatggggaaagacaatcattgaatacaaaacaaataagccatcacgcctgcccttccttgatattgcacctttggacatcggtggtgctgaccaggaattctttgtggcattgcccagtctgtttcaaataaatgaactcaatctaaattaaaaaagaaagaaatttgaaaaaactttctctttg

SEQ ID NO: 53931 - DNA, 359 bp, Homo sapiens
  misc_feature 2, 36, 274, 304, 333, 337: n = A,T,C or G
tnagcattgttgtctaatctctatgtaagctttatnatttttcctagtctgtacaattatattgaaaatgtctgaggttatttttatgtatttatcatggggggatattttatgaataattttaaccttacatgttaaactggtcatatgcagttgaaaaatgtcaaaaccaaagcttgtacttgttttcttttcaacatgcagtttagcaataatgggttaagagcatggactctcagaagtcaaactgccggagtttgaatactggttcctnctctccctttccgcctgggtttcagaatgntgcttaaacattctacctttgtttcttgnctgnaaaggggagataataataggac

SEQ ID NO: 53932 - DNA, 280 bp, Homo sapiens
  misc_feature 4, 56: n = A,T,C or G
ccgnggaagcccgaaggaaaaatacgaaaaggatattgctgcatatcgagctaatngaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgctataaagcatttaacccccctgtacacaactcactccttt

SEQ ID NO: 53933 - DNA, 295 bp, Homo sapiens
  misc_feature 4, 154: n = A,T,C or G
ccgnggagaccaaggagagaagctactattgattagagcctaacccaggttaactgcaagaagaggcgggatactttcagctttccatgtaactgtatgcataaagccaatgtagtccagtttctaagatcatgttccaagctaactgaatccnagttgaatacacactcatgaactcctgatggaacaataacaggcccaagcctgtggtatgatgtgcacacttgctagactcagaaaaaatactactctcataaatgggtggggagtattttgggacaacctactttgcttg

SEQ ID NO: 53934 - DNA, 398 bp, Homo sapiens
  misc_feature 1, 4, 285, 356: n = A,T,C or G
ncgngaagtccacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggntattatgattaagctttgcactgtttcactactcagcatggaaacaagatgaaattccatttgtaggtagngagacaaaattggatgatccattaagtaaacaataaaagtgt

SEQ ID NO: 53935 - DNA, 269 bp, Homo sapiens
  misc_feature 14, 15: n = A,T,C or G
gaggaccaatgggnncaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaat

SEQ ID NO: 53936 - DNA, 399 bp, Homo sapiens
  misc_feature 11, 33, 35, 36, 37, 46, 52, 63, 258, 326, 371: n = A,T,C or G
ccttccggganccggcttttggccgggagatcnannnatgttgatncaggcncgacccagctnagagttcttctttctttcttaagccctttgctctggaggaagttctccagcttcagctcaactcacagcttctccaagcatcaccctgggagtttcctgagggttttctcataaatgagggctgcgcattgctgttctgcttcgaagtattcaataccgctcagtattttaaatgaagtgattctaagatttggnttgggatcaataggaaagcatatgcagccaaccaagatgcaaatgttttgaaatgatatgaccaaaantttaagtaggaaagtcacccaaacacttctgctttcacttaaggnctggcccgcaatactggaggaacaagca

SEQ ID NO: 53937 - DNA, 180 bp, Homo sapiens
cacccaagtaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaaaaaaaaaaaaaaaaaaaaaaaaaa

SEQ ID NO: 53938 - DNA, 510 bp, Homo sapiens
  misc_feature 281, 414, 446, 509: n = A,T,C or G
atttgtgatatgttgaaaagctctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgntgctattaaattctgaactgtatccatattttaaggaaggagctaaaaatggaaattcatgaaacataaatggtatcaaagaactttatcagtatgctttgttgaaagcagaaattaagataataatttgagntcaattccgccctcttccgcattgccctattngatacccctttactaaatcatggaaattctaaccctaaaaggaaaaacattttccctgcttgnc

SEQ ID NO: 53939 - DNA, 280 bp, Homo sapiens
  misc_feature 239: n = A,T,C or G
taaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactggcgntttttcattcttggatttgactatttaatcctttctacttg

SEQ ID NO: 53940 - DNA, 300 bp, Homo sapiens
gtgaagctggagatatttcggatggtaatctacctcactttccctgtggctatgttctgggtttccaatcaggccgagtggtttgaggacgatgtcatacagcgcaagagggagctgtggccacctgagaagcttcaagagatagaggaattcaaagagaggttaccggaagcggcgggaggagaagctccttcgcgacgcccagcagaactcctgaggcctccaagtgggagtcctagcccctcccctgatgaaatatacatatactcagttccttgctaaaaaaaaaaaaaaaaaaaa

SEQ ID NO: 53941 - DNA, 280 bp, Homo sapiens
aaaggtcgtgaaaaaaaagtcttggtgaggtgccgccatttcatctgtcctcattctctgcgcctttcgcagagcttccagcagcggtatgttgggccagagcatccggaggttcacaacctctgtggtccgtaggagccacctatgaggagggccctgggaagaatttgccattttcagtggaaaacaagtagtcgttactagctaagatgtgtttgtactttggatctgcatttgctacacccttccttgtggtaagacaccaactgcttaaaacata

SEQ ID NO: 53942 - DNA, 270 bp, Homo sapiens
  misc_feature 14: n = A,T,C or G
tagtaggcctaaancgccaccaattaagaaagcgttcaagctcaacacccactacctaaaaaatcccaaacatataactgaactcctcacacccaattggaccaatctatcaccctatagaagaactaatgttaggtataagtaacatgaaaacattctcctccgcataagcctgcgtcagattaaaacactgaactgacaattaacagcccaatatctacaatcaaccaacaagtcattattaccctcactgtcaacccaacacaggca

SEQ ID NO: 53943 - DNA, 319 bp, Homo sapiens
cccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcaggtgtcaggcatgggagtcattgtccacatcatcgagaaggacaaaatcaccaccaggacactgaaggcccgaatggactaaccctgttcccagagcccactttttttttctttttttgaaataaaatagcctgtctttcaaaaaaaaaaaaaaaaaaaaaaaaaaaaa

SEQ ID NO: 53944 - DNA, 367 bp, Homo sapiens
  misc_feature 18, 38: n = A,T,C or G
cccttactccttcacagnatcggtgtaatcctgagaanttcacatggtgttgcacaagtacgttttgtgacaggcaataaaattttaagaattcttaagtctaagggacttactcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaacc

SEQ ID NO: 53945 - DNA, 460 bp, Homo sapiens
  misc_feature 9, 424: n = A,T,C or G
atgtcaagnactaccgatggttacttgcttcgtctgttctgtgttggttttactaaaaaacgcaacaatcagatacggaagacctcttatgctcagcaccaacaggtccgccaaatccggaagaagatgatggaaatcatgaccccgagagatgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagntcagacttcaaatagtggcaaataaaaagtgctatt

SEQ ID NO: 53946 - DNA, 300 bp, Homo sapiens
  misc_feature 55, 100, 118, 128, 207, 253, 254, 256: n = A,T,C or G
cattggaaatgaaattaatatcttctacttggtaagaaattacctctaaaatagnattctaaaggagttatttgtaaatatataaattaaagtattaacngacgcataaaaatatgtngcttcaatgnttaatctctatatttccagcatattttctttataatttcataaatataaatatagacatataatatataaatataattntcaatttatatttttctttataatttcactgaagatttaaatttgnngnaattatattttcacatcagtttagagatctaagcctctaatttc

SEQ ID NO: 53947 - DNA, 140 bp, Homo sapiens
agaaccccagcaatcccttcctttcactaccttcttttttgggggtagttggaagggactgaaattgtggggggaaggtatggaggcacatcaataaagaggaaaccaccaagctgaaaaaaaaaaaaaaaaaaaaaaaa

SEQ ID NO: 53948 - DNA, 297 bp, Homo sapiens
  misc_feature 68, 258: n = A,T,C or G
acatgaagctgtataattaattgtcattatttttgttagcaaagattaaatgtgtcattggaagcccntccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcncaagtccttttgcaaaaaaaaaaaaaaaaaaaaaaaaaa

SEQ ID NO: 53949 - DNA, 550 bp, Homo sapiens
catacagcaaaggcgggggaggaggcgtggcaaaggtaacttggaggaaaaagttaaaagtaaattgacaactactatttttaatatcttgtttgttttattttcttctaaacttatacaacaacatactatttttgttgttttctctacattaatgtgatcataccatacatactggcctgtaatctgcttatttcactcagtagtagaaaaaatgtctttaatattctttttaatacctttatagataccataactaatttaacaatttcatggccaggcgtagtggcacacgcctatttcagcactttgggaggccaaggcggatggatcactttgaggtcaggagttcaacaccagcctggccaacatggcaaaaccctgacactactaaaaatacaaaaattacccaggtattgatggtgcacacctatcatcctggctacatgggaggctgaggtggaagaattgtttgaacccggaaggaggaggttactgtgagctgagatcacaccactgcactccagcctggatgacagaatgagactgt

SEQ ID NO: 53950 - DNA, 278 bp, Homo sapiens
tgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtatttttatttaaaagttttgtaataaatttctaaattaccaaaaaaaaaaaaaaaaaaaaaaaaa

SEQ ID NO: 53951 - DNA, 294 bp, Homo sapiens
agattgcaacaaattcggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcgaaaaaaaaaaaaaaaaaaaaaaaaaa

SEQ ID NO: 53952 - DNA, 280 bp, Homo sapiens
  misc_feature 250: n = A,T,C or G
agcatcactgtgagtaacagccttccagtttgtacccttttgattcacagcatggccctatagttaattaagaggtggataacttaagctcacaactgcctttaatttgatttcacatccacagttataaactttgcatttaaaaggaaaatgagacatttaaataggttcctgttgtttcacatataattggtaaaaacatattcccttgtaggatcctattatcagagcatcaaattaccccaaaagntcagcaacttgggttgccaaataaattagg

SEQ ID NO: 53953 - DNA, 360 bp, Homo sapiens
acttgaatttgtactgttaacagcacatttggaagattttaaaactttttattgtcttataaatagcattcacttattattttggatatttaagggttccattaagttaacactgtatttggacaaagtgtgaccaaattagcccagtctgttttcctccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttgggggtagcttttccatcctcaaacttaatgtttttacta

SEQ ID NO: 53954 - DNA, 250 bp, Homo sapiens
atttggaatgaattaaagtgaagacataacaccaaaacttacgggaagcaataaatgcagagcttagaaggaaatttatattaataagagatctcagtcacaatgtcttgtgcctataatcccagggacttgcaaggctgaggcaggaggatcacttgagcccaggagttggaagctgccatgagctgtggtcacaccattgcactccagtctgggccatagagtgagactaaaaaaaaaaaaaaaaaaa

SEQ ID NO: 53955 - DNA, 190 bp, Homo sapiens
aaaaaacaagagcaagcccaaaggaagtaaagggacagaaataacaaggaaaggggtagaaattaatagaaaaatagaaatgaccaacaaaaccaaaagtgggttatttttatttgtctaataaaatagataaacttctggcaagactgataaataggaagacagaaaaaaaaaaaaaaaaaaaaaaaaa

SEQ ID NO: 53956 - DNA, 168 bp, Homo sapiens
  misc_feature 22, 73, 75, 78, 94: n = A,T,C or G
atttcaataaatctttcaaagnccttaccttgaaatgctgttagtaaatttctgtgatttttttttttaattngnttngctgagagcatagctntttgtttttattgtaaaacaataataataataaaaagcaaactccaaaaaaaaaaaaaaaaaaaaaaaaaaaaa

SEQ ID NO: 53957 - DNA, 110 bp, Homo sapiens
  misc_feature 26, 27, 58, 61, 63, 74, 83, 99: n = A,T,C or G
ggccactgtgccacgagcagcacttnngctgcgtcactctgtgccgccctgcgactanacnantgttttgcttncggcaaacncatgtcccttgtacanacaccccggaa

SEQ ID NO: 53958 - DNA, 378 bp, Homo sapiens; identical to SEQ ID NO: 52496

SEQ ID NO: 53959 - DNA, 370 bp, Homo sapiens
  misc_feature 272, 302: n = A,T,C or G
atagcacatctcaacattggaatcaactgatatgttatcctgtcccatctactggattcatgtttgtgcagtgcttccttaaccacctctatataagcagagggtattgtgataatgcaaggtaagttgtttaaaaaaaaaatcaccacttgcatctccctatctgtgtgaatatggactctctccaagttatgtaagcaaaagccatgacagatattggctgcaggttcatttatcctcaactttccggtataatctcaattttgaattgntttgtgtttactgaaacaacttcatgaagngactttaaaaaatacaatgtaaaaatatattctataatttcaatgttataaagtacatttatattaat

SEQ ID NO: 53960 - DNA, 400 bp, Homo sapiens
aacggaaaccatgccttcagaattctataaagttattttcaactgataaatctatattcaggcaaagaatcaagggtgaaggtaaaataatacatttttagacaagcaaagactcaggggttacatgtaccctttcttgggaagctatcggagaaaatactccagcaaaatggaaggcgtacacaaaccagagaatggacgtggatccagcaaatagtatccaacacaggcaatattccagctatggagctagctttaaaaagaaacagtaaaaatactaatagttagcttgggtgggggatggcccatgctttgtagtcccagctactcaggaggctaagcaaaaggacggcttgagcccaagagttcagagcagcctggccaccatagtgagatccct

SEQ ID NO: 53961 - DNA, 266 bp, Homo sapiens
  misc_feature 9: n = A,T,C or G
atacatggnaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgagg

SEQ ID NO: 53962 - DNA, 410 bp, Homo sapiens
acccatagtaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacttgcttggctttaaaatatatttatttgccatttaagtataaatatggaatctgtttcttattggggaagatagaatatatatatttttcctttaaactttttaaggtcacttttaaataaccaaatttgat

SEQ ID NO: 53963 - DNA, 280 bp, Homo sapiens
catgaaaaaagtctcctaaaattgtgaaactagttcttgatgagtgatgtgatcctcagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacctttaaataaccaaatttgatttatgggtttttaacaaaggactaaagagctgaaaccaac

SEQ ID NO: 53964 - DNA, 430 bp, Homo sapiens
  misc_feature 14, 378: n = A,T,C or G
aagtgattctaagnatttggtttgggatcaataggaaagcatatgcagccaaccaagatgcagatgttttgaaatgatatgaccaaaattttaagtaggaaagtcacccaaacacttctgctttcacttaagtgtctggccccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgataagaggaatttggtataattatgggggggtgattatttttttatacctgnatgtgccaaagctttactactgtggaaagacaactgttttaataaaagatta

SEQ ID NO: 53965 - DNA, 236 bp, Homo sapiens
aggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagtaagacccaaagctagaaagggaggaggaagaaactgacccgatcagtgccagaagtcattgtattcaaagaagaataagc

SEQ ID NO: 53966 - DNA, 210 bp, Homo sapiens
agacttcttgattgtcagtctgtgtcacatccagtgattgttttggtttctgttccctttctgactgcccaaggggctcagaaccccagcaatcccttcctttcactaccttcttttttgggggtagtttggaagggactgaaattgtggggggaaggtaggaggcacatcaataaagaggaaaccaccaaaaaaaaaaaaaaaaaaaaa

SEQ ID NO: 53967 - DNA, 400 bp, Homo sapiens
  misc_feature 357: n = A,T,C or G
cacctaaatgtttatataatctggctaacctgatccgagcaaatgagtcccgactggaagaagcagatcagctgtaccgtcaagcaataagcatgaggcccgacttcaagcaggcttacattagcagaggagaattgcttttaaaaatgaataaacctcttaaagcaaaggaagcatatcttaaagcactagagctggacagaaataatgcagatctttggtacaacttggcaattgtacatattgaacttaaagaaccaaatgaagccctaaaaaactttaatcgtgctctggaactaaatccaaagcataaactagcattattcaactctgctatagtaatgcaagaatcagggnggagggtaaactcagaccctgaagctagaaaacgacttctaag

SEQ ID NO: 53968 - DNA, 380 bp, Homo sapiens
  misc_feature 11, 368, 369: n = A,T,C or G
tagaactgaangtgtagaaataaaccaatataatagggcttttatggataattgatttttgataagggttccaagacaattcattgggggaaagaacactcttttcaacagatggtacggtaccaggacaactggatttccacttctgcacatgaatgcagttgaactcctacctcctatcatatataaaaaaaaatacaaaaaattagctggatgttgtggtgcatgcctgtggtcccagctactcgggaggctgaggtgggaatcatctgagtctgggaagtctgagtctgaggctacagtgagctgtgattgcactactgcactccagcctgggtgacagagtgagaccctatctcaaaaaaaannaaaaaaaaaaa

SEQ ID NO: 53969 - DNA, 200 bp, Homo sapiens
ataactaggtagttgtagtaacttaaaataagaatattactctttatgataaagtacaaggatgcatcttttgcctttgggtacttctagaaactaatcttacttttacaccaagatcctaatccttgccagaacactgaaagaaaaattaagagcccatgcaaccatccattagaatgaaaaaaaaaaaaaaaaaaaaa

SEQ ID NO: 53970 - DNA, 250 bp, Homo sapiens
  misc_feature 43, 102: n = A,T,C or G
tgttttgtgtgtgtgtgtgtgtgtgtgtgtgtatccataaaangcatatgtaaatttttttttgtttttaagcattcacccaaacaaaaaaatcacaggtanacccatgtttctgagatgccattattccaagcaaaataagagataatcccttcaagttaaattgaaaattttcctgaaaccatacatttcaagtgaaataagtaattctagataggacaatttaaattggataattttaaagtgtcta

SEQ ID NO: 53971 - DNA, 218 bp, Homo sapiens
  misc_feature 143: n = A,T,C or G
tatgtagttggattttttggagtccgaaggtatccatctgcagaaattgaggcccaaattgaatttggattcaagtggattctaaatactttgcttatcttgaagagagaagcttcatagggaataaacaagttgaatagagnaaaacactgattgataataggcattttagtggtctttttaatgttttctgctgtgaaacatttcaagatttattg

SEQ ID NO: 53972 - DNA, 450 bp, Homo sapiens
  misc_feature 287: n = A,T,C or G
cttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatggngggatgttttacccacatgacttattatgcataaagccaaatttccagtttaagtaattgcctacaataaaaagaaattttgcctgccattttcagaatcatcttttgaagctttctggttgatgttaactggagctactagagatattccttattttcacta

SEQ ID NO: 53973 - DNA, 380 bp, Homo sapiens
ttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaaccggtctcagaactgtttgtttcaattggccatttaagtttagtagtaaaagactggttaatgataacaatgcatcgtaaaaccttcagaaggaaaggagaatgtttttgtggaccactttggttttcttttttgcgtgtggcagttttaagttattagtttttaaaatcagtacttttttaatggaaacaacttgaccaaaaatttgtcacagaattttgagacccattaaaaaagtt

SEQ ID NO: 53974 - DNA, 300 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaaaggtttctaaaacatgacgggaggttgagatgaagcttcttcatggagtaaaaaatgta

SEQ ID NO: 53975 - DNA, 280 bp, Homo sapiens
aagaagatagaagacaacaacacacttgtgttcattgtggatgttaaagccaacaagcaccagattaaacaggccgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatattcttttcaccctaaaaaaaaaaaaaaaaaaaaa

SEQ ID NO: 53976 - DNA, 530 bp, Homo sapiens
  misc_feature 101: n = A,T,C or G
aaaatgctaaaacgagatctaaatcctgaaacaaaacctcgaaatacaccaaaatagaacctcgttaaagtgtaaatctcacagggcctattaaacactancaaaaagaaaaaacccaagatgttcaggcaacagctagcacgatgaataaaacagtacctcacatctcagtacttatgttgaatgtaaatgacctaaatgctcacttaaaaaaatacagaatggcagcatggataaaaatccacccaccaagtatctgctctcttcaagagattcacttaacgcataagaactcacttaaggtaatggggtggaaaaagataccccatgaaaatggaaaccagaagtgagcaggagtagctattcttatatcagacaaaacagactttaaaacaacaacagttgaaaaagacaaagggagacattatgtaatgattaaaaagatccatccaacaagaaaatatcataatcctaaatatatatgcacccaacactggagctcccaaatttataaaataattattactaga

SEQ ID NO: 53977 - DNA, 390 bp, Homo sapiens
  misc_feature 16, 17: n = A,T,C or G
caaaaacaaataagcnntcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaattttttttttcaacactcttacacctgttatgggaaaaatgtcaacccttttgtaaggaaaacccc

SEQ ID NO: 53978 - DNA, 390 bp, Homo sapiens
  misc_feature 25, 372: n = A,T,C or G
atatcaacacctgtttaatctgatnatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattaggggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggcatttgtagaaagaagntcagtggctgagaatctg

SEQ ID NO: 53979 - DNA, 350 bp, Homo sapiens
  misc_feature 271: n = A,T,C or G
agagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggagggaagttctccagcttcagctcaactcacagcttctccaagcatcacccttgggagtttcctggnggggttttctcataaatgagggctgcacattgcctgttctgtttcgaagtattcaataccgctcagtatttaaaatgaa

SEQ ID NO: 53980 - DNA, 420 bp, Homo sapiens
  misc_feature 301: n = A,T,C or G
gtgtgggcttgggaggtctggtagggctgagctttgcaagaggatcaacactgccctttggcttagagatttacttacatccgtccttggaagaggaaaagaaaaaaacataaaaagaaacgcctagtacaaagtcccaaattcttactttatggatgtaaaatgtccaggttgctacaagatcaccacggttttcagccatgctcagacagtggttctttgtgtaaagggttgttcaacaggtggttgtgccagcctacaggaggaaaggccagactcacagaagggtgttcattttagnaagaaagcaacacttaatgattcaaacagcttcctgaattttaatttttgggggtggcctcacagaaagccttatcataaattccataattctaattaatttaccaagataatgaatta

SEQ ID NO: 53981 - DNA, 380 bp, Homo sapiens
tacattaatgtagggccttcctttgtaagatccttttatggtagcaaaatgcacaaatcttccatgtatagcttcatgaacttttacatctggcccatgtaggcaccatgcgacaagactgagggagttagtacagaaaggtatgaacctgtatgttaccatgaagttacatacaggaaaagttaccatgaagaaaatgagggatagggatgatctagggtacatttcatgactctgtgcccaaagatggctatcttttaatctgtctcttctcttggtgtctagcccaggtaacatttagcaaggtttttaatccatgttttaacaacagcaaaccttcaatagttaatgaaagataaaattaatcctctctatatgga

SEQ ID NO: 53982 - DNA, 460 bp, Homo sapiens
  misc_feature 15, 41: n = A,T,C or G
tctttctggtcaaantggctggtaagcaggccgtttcagcntcaggcaagtggcctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagagggaaaatttctaccttgaaccgtatctgaaagaggttattcggggaaagaaaagaaagaggaagaatgggcaaagaagtaatcatgtagtttgaagtctgtggatgccagcctgttatgaagatggttaaacttgaaacaaacaattttaagaattattttggtccggaagaatgttttacttttaa

SEQ ID NO: 53983 - DNA, 490 bp, Homo sapiens
  misc_feature 2, 21, 30, 31, 57, 58, 69, 120, 147, 443, 474: n = A,T,C or G
gntaaatgttttgtaaacatntattttttnnaaagaaaagaatgaagggcaggcctnnttgcatcacangaacacacacatatacacgaatagacatcacactcgctgctttagtttganaatttagagtttttttatttcactggncaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcataccttacctagtgaaacttttctagaattatttttcactctaagtcatgnatggttctctttgattatttgcatggtatgnttaaataagctactag

SEQ ID NO: 53984 - DNA, 371 bp, Homo sapiens
  misc_feature 15, 344: n = A,T,C or G
actgcgataggaatntgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaaggggcgcactctgtatggcttcggcggctgaatctaagaatacgcggnctcctgagaacttcaaaaaaaaaaaaa

SEQ ID NO: 53985 - DNA, 120 bp, Homo sapiens
  misc_feature 2, 8, 49, 96: n = A,T,C or G
gnagttcntgagcatgatgattgggtatttcgtgcacatgtgtgaagangtgccaccctcgaacctttgttaatgaacatcggcacatttgctcantctaacagaaaaaaaaaaaaaaaa

SEQ ID NO: 53986 - DNA, 310 bp, Homo sapiens
ctgtatcttgatgtttagaaaagtattcgttacatcttgtaggatctactttttgaacttttccttccctgtagttgacaattctgcatgtacctagtcctctagaaataggttaaactgaagcaacttgatggaaggatctctccacagggcttgttttccaaagaaaagtatttgttttggaggagcaaagttaaaagcctacctaagcatatcgtaaagctgttcaaaaataactcagacccagtcttgtggatggaaatgtagtgctcgagtcacattctgcttaaagttgtaacaaatacagatg

SEQ ID NO: 53987 - DNA, 370 bp, Homo sapiens
  misc_feature 350: n = A,T,C or G
ctttgtgtatctgcaacctcattccgagcaccagggtgtggtttactgcagggcggaggccgggggcagacctcagatctccgtcaagtaccagctgctctacgtggcggttcccagtggccctccctcaacaaccatcttggcttcttcaaacaaagtgaaaagtgggggacgacatcagtgtgctctgcactgtccttgggggagccccgatgttggaaggtggagttcacctggatcttcccagggcagaaggatgaaaaggcctgggacgatccaagacacttggagggttgatccacagagggactgggacacaccacgagaatctcccagagtgtcattacagnggaaagacttttgagacgat

SEQ ID NO: 53988 - DNA, 138 bp, Homo sapiens
  misc_feature 22, 23: n = A,T,C or G
atggtagtcgccgtgccttacnntggtgaccacgggtgacggggaatcagggttcgattccggagagggagcctgagaaacggctaccacatccaaggaaggcagcaggcgcgcaaaaaaaaaaaaaaaaaaaaaaaa

SEQ ID NO: 53989 - DNA, 378 bp, Homo sapiens
  misc_feature 5, 6, 57: n = A,T,C or G
agagnnggcaaagtgggcttccagagctttctttttccctaattgcgggcctcaccnttgcatgcaatgactacttttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtatttgtttgcatccccttgccctcaataaataaagttctttttttagttccaaaaaaaaaaaaaaaaaaaa

SEQ ID NO: 53990 - DNA, 330 bp, Homo sapiens
tgggaagggggtatggtgagtgcggcaatccctcctcctctttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatc

SEQ ID NO: 53991 - DNA, 290 bp, Homo sapiens
  misc_feature 75, 191, 224, 248: n = A,T,C or G
cccttttctaatgaccagggatgttttcgcatttaaagaggggcacttggaccctgaactttgaagcatcaagantctttgcctaaagagccagtggacccaaatatgaaagagggaaaaatttctacccttgaacccgtatcctgaaagaggttattcggggaaagaaaaagaaagaggaagaatgggcnaaagaaagtaatcatgtagttttgaaagtctgntggatgccagcctgttatgaaagnatgggttaaactttggaaacaaacaatttttaagaattattt

SEQ ID NO: 53992 - DNA, 220 bp, Homo sapiens
  misc_feature 39, 138, 163, 181, 196: n = A,T,C or G
tctagtttctttaatattttgtgtttctgaataataggnttaaagcaatatttgtttaaaagttttcttgcactatcacaattgctttttagttattttctcaagaagcatgttcgtattagagacaaaatctgtgtnacagggagggagaatagcgccaagnctctgggctattttttanttttttgcaaatggngctttctaatagccattgccttcc

SEQ ID NO: 53993 - DNA, 290 bp, Homo sapiens
  misc_feature 46, 83, 234: n = A,T,C or G
tcaacttggaaaaaagtgtttaaaactgtttttttcttaagcaganttggtgatgtcatcaatatctactgatatcgattggnaaaaggtctttctttgttgaggatttgagctctctttttaagagtttattttattttaaaggaacatatgctttgaataacaattctctgggcatgtttaactaacctaggtgggaaaaccatggtgctgtttaattgtaatagattgatnttaagattggaccagtaccttgatgtgtataattttagtatgtaggggttatgtgc

SEQ ID NO: 53994 - DNA, 359 bp, Homo sapiens
  misc_feature 44, 66, 71, 101, 104, 131, 154: n = A,T,C or G
tgcctggaaaccctgaaaaaagtttccaagtgtactctcagacnaagggaagttgtgcccttttcnagctncttacctgtctggtttttaaccactttccnttnctctttagtgaactacgccttgctcanttttttcttacacaaattttttnttcaagttatttgtacagctgtttaaagatgggcagctagttcgtagctttcccaaataaactctaaacatttaatcaatcattctgtgtgaaaatggggttggtgcttctaacctgatggcacttagctattcagaagaccacaaaaattgactcaaatctccagtattcttgtcaaaaaaaaaaaaaaaaaaaaaaaaaaaaa

SEQ ID NO: 53995 - DNA, 210 bp, Homo sapiens
  misc_feature 11, 34: n = A,T,C or G
aaggatgtctnttttctacccatttaactagttnaaaccatgacatgtaaatgtagaagtagaataatcattagaattccctaaaatatttctgtttactaacatatattgaccaagtacatcaagcaggagagatcttcctttcattgctgttatagtccacatcattctaattttgctcagttgttattaagagcatattcctaaacc

SEQ ID NO: 53996 - DNA, 170 bp, Homo sapiens
  misc_feature 38, 65, 121: n = A,T,C or G
tggtggtgggtgggcccttcaagcttgaatgccttccntgtggggaaagggggttgggggttgancagtcatcaatcaagggccctggggccctgagaagaaattggctcaaataaaagantttcaagactccaaaaaaaaaaaaaaaaaaaaaaaaaaaaaaaaaaaaa

SEQ ID NO: 53997 - DNA, 258 bp, Homo sapiens
  misc_feature 23, 53, 61, 120: n = A,T,C or G
aagttcccaacttctaaaccttnaacccccagcttgtggtcttcttgagaganctgaagangtcgaggcttcccttggccagggcagcccctttcaggagctcctttagtaaaggacttntcaaactggtttcaaagcacagagctcaagtaatttacaccagaaataccaagggtggagatgctccagctgctggtgaagatgcatgaataggtccaaccagctgtacatttggaaaaataaaactttattaaatca

SEQ ID NO: 53998 - DNA, 280 bp, Homo sapiens
ttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctccaaaaaaaaaaaaaaaaaaaaaaaa

SEQ ID NO: 53999 - DNA, 401 bp, Homo sapiens
  misc_feature 6, 7, 77, 93, 95, 96, 112, 120, 143, 144: n = A,T,C or G
ggggannttgtcttgcaggcacctcagactggtccagcgtttgacctacccgacgtaaggcttttccctccactacnagccctcttaacaaancnnaggcttgtccccgaancccctggnaataagaaattgtttaccttttnncccaaggaaaggttgggaaaagcaccaaaaatctgcatgtgggtgtgtgcccaggcagacttcgaggggttcgtgcctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaat

SEQ ID NO: 54000 - DNA, 280 bp, Homo sapiens
  misc_feature 237, 279: n = A,T,C or G
tatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgngttagtgtatggaccaatactgcctgtaataaagattttatnt

SEQ ID NO: 54001 - DNA, 370 bp, Homo sapiens
  misc_feature 38, 55, 69, 75, 119, 129: n = A,T,C or G
agttcagtggtggaggactgcttttgtgaacctgagangcagcgcctggtccctngtatttgggtcttntttacntccttctttaagcccagtggctcctcagcatacttcttaaactnaatcactttntgttaaaaaagaaccaaaagactcttttctccatggtggggtgacaggtcctagaaggacaatgtgcatattacgacaaacacaaagaaactataccataacccaaggctgaaaataatggtagaaaactttattttttgtttccagtacagagcaaaacaacaacaaaaaaacataactatgtaaacaagagaataactgctgctaaatcaagaactgttgcagcatctcctttcaataa

SEQ ID NO: 54002 - DNA, 370 bp, Homo sapiens
  misc_feature 19, 31: n = A,T,C or G
cagttgctttaacctctcncttggaaagacntttttttaatgttctacatcactttctgtttgtatttacaatgtatgtagaaatagtaaccctgtgaactatgcttttccctaacttttttaaaaatatatatattctaaatgaatgcaatgtgcataaatattttttaaacataacagtgaactattgcacctttttgctaatgcctctattttactttgctttggcataaagaatgagccaatgaaccctctgtgtcctgtggaaaaatgtataaatgttatctggatattgctctttagatgtaatgctaattaatgttaaatcacaaataaacagatttttaagtaaaaaaaaaaaaaaaaaaaa

SEQ ID NO: 54003 - DNA, 240 bp, Homo sapiens
  misc_feature 20, 75, 110, 156: n = A,T,C or G
attttggaagtttgaccttnactggaaagatatgggagaagaagaatttggaaaaaaagtgggagcatttcagantttgtcttttcagcaagggactgggtcttttctantcttctttgtactacacttgaattcaccccccacttgaaaaaagangagtatgccttgcccgtgtgaacccatgtgacttttgtcacagcccaagatagttaaagtggggatcgagacatgtgagcagca

SEQ ID NO: 54004 - DNA, 200 bp, Homo sapiens
  misc_feature 23, 28, 44, 48, 49, 59, 62, 74, 75, 79: n = A,T,C or G
caggaacccctgtgtaagtcccntcgcntctctgcctcccagcntaannaggtaccttnctnctttgtgaagcnnaaantgcaaagtaaagtgaacccagaaagggtaggtcgcaaggtgtggatttaaagtttgtttgtaattcacagcagtaacaggtttttgaaattagtgaaatgaacagaattagaatatgggtc

SEQ ID NO: 54005 - DNA, 400 bp, Homo sapiens
  misc_feature 31, 63, 102, 126, 295: n = A,T,C or G
tctggaaaggtaaagtactttaaaacaaacntcttttaaaaacttcaccctgtactttttacncactccaaaccctgtttaaaatgtaaaatgatagccacntagagtgatatagtacagtcatantattacagtagctctgagtgagttaccagaaatgaacttcttttgtcttcctgttctaatgcttacaaatttatcatttacctgccatttacttttcttcactttcagtttgagagggaaaagttacctttttcctctagatgaaagatacttctctctgttctctggnttctgttactccttctcccaaaattcaagttatgaaatcttctgttttttaagtctttcctttctctttttgattccatctctgggagtctgtaaatattgcttt

SEQ ID NO: 54006 - DNA, 410 bp, Homo sapiens
  misc_feature 107: n = A,T,C or G
agataaaagccttggactgggtgatggtttggatctggtgagtgaaggagaggaaggtgtgaagagtgattcccaagtctccagcttgagccataatgagaggtggnggaagacaggcggggaagcaggattagacttaacactatgcagacacccgtgaactaggtaagttgaatacacagcctgaaacttagggcaggtgtctgggttagggatgtacctttggaagtgctcaggattagaaagcatttgaaatcttgggaatggaagacatcacccgggagagacccttattttttagagtttggtaaatgagaaaaatgagtagtgtgaccgacctagaaataggttacaggtttctcccatcctgtgagaaaccatgtgagttttggactagagttcaatgctgt

SEQ ID NO: 54007 - DNA, 440 bp, Homo sapiens
  misc_feature 49, 76, 410: n = A,T,C or G
ccttgaggatagtcttcctgttcaaaaggcacttctgcttttcttctcnaactttccttcagaagactgaaccacntgatattctcagccctgttaacactaaaaatatttaaaaactgaatgatagtagtgactcattgtattacttaaaacttatataacacgctgtattagatgtgtgtaaattagccaaaggttattttacaaagtgagacattggtttttatgtctaaatgctatttctgaatgaatgaaatagtaattagatcaagagctgattagcatcaatgtgtttgaaagatataaaatttatacatcaccttaacctctgtatgcacatgatgggattgataaaatatttaaatgagaacaaactagatatggattaggacatttgaaaccctaattgngaatttatttttaaatagggtacctggaaa

SEQ ID NO: 54008 - DNA, 280 bp, Homo sapiens
agaacagcagcttttcttagggacagctggaaaggacttaatgtgtttgactattttcttacgagggttctacttattttatgtatttattttttgaaagcttgtattttaatattttacatgctgttatttaaagatgtgagtgtgtctcatcaaacatagctcagtcctgattatttaattggaatatgatgggttttaaaatgtgtcattaaactaatatttagtggggagaccataatgtgtcagccaccttgataaatgacagggtggggaactg

SEQ ID NO: 54009 - DNA, 320 bp, Homo sapiens
  misc_feature 25: n = A,T,C or G
ccacccaaaggggtacctgataaantctttggaacttttaaaggctcaacactccttctgagtaagggtaaagtggaagattaaccctttgcagaaactgaagacaagattaaaatcattttcagtccctgaaactggatcaatataactcaaagattctagtgcccctactttatcttccataaataaacacaaattattcttttttctttttttctttaattttcatactaccatatccagcaggtggtaaaaagaaaccaagcacatgagaagacaaggcaagaatcgagaaaacagcaaaaagagagttctagata

SEQ ID NO: 54010 - DNA, 330 bp, Homo sapiens
  misc_feature 77: n = A,T,C or G
tgaaaaccttgatcacctgggtttctttactttactcgactgtgtcatgacaaggaaacttacaaactgcaacgcanagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattatttttttaaagtcttctttcatgtaagtagcaaacagggctttactatcttttcatctcattaattcaattaaaacc

SEQ ID NO: 54011 - DNA, 480 bp, Homo sapiens
  misc_feature 42, 71: n = A,T,C or G
aactgagaagctctcctacatccgcattgctgataccaatantcaccagcattcctcaaggtcttcctccntcccttacggaattacactcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtggtgagtcttttcagcaacccggtccagtactgggagatacagccatccaccttcagatgtgtctacgtgcgctctgccattcaactcggaaa

SEQ ID NO: 54012 - DNA, 289 bp, Homo sapiens
  misc_feature 6, 17, 31: n = A,T,C or G
gaggtnagggacaaganggtgccaccggtgnaggtctctccgctcatcaagctcggccgcttactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgat

SEQ ID NO: 54013 - DNA, 280 bp, Homo sapiens
aaaaaaagcttttttaaattctactacccttccttagtagataagtgaaagagcagggaaagagacctttaaatatttttgctataaaaaaatttgtgataagtttctattcaaaatgggggagattgcagaaaaggcttccctttggctcccaaggaggtgtagcaggtgtgagcaatattagtgccatgtgcctttcacacagggtttgcatttatcagtctgttttccgatgatgtgtacatgaaagagtcacccatgtgaggagaagagagaatga

SEQ ID NO: 54014 - DNA, 399 bp, Homo sapiens
  misc_feature 7, 51, 69, 237: n = A,T,C or G
gtgaccntggtacttttaacctcagaatgtcaaattttggcttgaaccacngacatccaattacagaangaatataagcaatctcacaggcctgcaatcggcactgtctctgtgtggtcataggagatgatttttgaggttgcactcatgcaatttgagaacaccgttgacaagaaggctgagtttacataaatgatctagattgaaactcagctacctttcttcctcatgtggtgnaattacagccctatctggagacagcgaatacagcaaacagattttattacctaagtcgctcaaacactacatgaaggtatttaggtaaagccctcccccaaaagttataaaaccatttatcaagggcccaacatggggatgcaatgaagagaaaatgtaaag

SEQ ID NO: 54015 - DNA, 228 bp, Homo sapiens
  misc_feature 1, 10: n = A,T,C or G
nggggaaatncaacagaaatccggagtaaccacaacacaacattcacaatgtccagaatataatccaaaaatattcaacacagaaagatccaggaaaatgtgagctattttcaacagaaaacactatcactgaagactgatccctacttggctgaatgttggaatacatagataagatttcaaagtagttattatatgtactcattaacatcagagaaaatatgattg

SEQ ID NO: 54016 - DNA, 197 bp, Homo sapiens
  misc_feature 10, 13, 40, 45, 53, 57, 84, 121, 155: n = A,T,C or G
aaatgaaaancantttcagagatctttctttcaagatatngtttncctggatnaaanacatggtcttggaagtaaatacattgncaaaacctaattgcaattctgttaaatctaagtaatntttagacagtgtttcaccgtattatttaggatgngaaatgccatttctttcactgattacaccatatacaggaaac

SEQ ID NO: 54017 - DNA, 331 bp, Homo sapiens
  misc_feature 3, 18, 34, 39, 48, 284: n = A,T,C or G
ccncagtctgtttcaaanaaatgaactcaatctnaaatnaaaaaaganagaaaggtgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgnaagaaaaccaaaataaaaattgaaaaataaaaaccataaacatttgc

SEQ ID NO: 54018 - DNA, 119 bp, Homo sapiens
  misc_feature 4, 26, 55, 58, 72, 79: n = A,T,C or G
cggngaggccctaattttgtaattgntaaaaatagagttaattttgactttgttngangagggaggaaaacncaactgnttctcttgggtatctaaatgctcagaagtcaatcgtgaag

SEQ ID NO: 54019 - DNA, 353 bp, Homo sapiens
  misc_feature 2, 21, 40, 45, 50, 191, 345: n = A,T,C or G
tntaagtgccacaggcttgangggattctgcagaataaanagacnaaagnccctcagatgagaacctacaaaagcttgtgtatcttgattaatgactttttattgcatggtgtgaactaagttattgctgcataaatttgtaatatatcctgtttgtatttttttccaagtgtataatgttggtgtggagntttcatgacagaatatacacattttgtaaatctgtacttttttcaaatattgaatgccttatttttgaatctttagattttaaattggagaaaagcacttaaagtttttatatatgaatattacatgtaaagctgtaaaatacataacttcagngcaagagt

SEQ ID NO: 54020 - DNA, 292 bp, Homo sapiens
  misc_feature 8, 10, 30, 39, 49, 50, 54, 244, 264: n = A,T,C or G
ccactgcnanaatagcattgcatacatggntcaggccanaggaaatgtnnaganggccctgaagctgagggggtcaaatgaaggtgaattcaaggctgaaggaaatagcaaattcacctacacagttctggaggatgggttgcaccgaaacacactgggggaatggagcaaaacagtctttgaatatcgaacacgcaaggctgtgagactacctattgtagatattgcaccctatgacattggnggcctgatcaagaatttggngtggacgtggcctgttgcttttataaac

SEQ ID NO: 54021 - DNA, 288 bp, Homo sapiens
  misc_feature 9, 18, 31, 38: n = A,T,C or G
tatgctcantgaaagcancaagccccaaatncatgatnctacaaacctcagggggaagcccgtcccccaaagctaaaagaaaacttaaaaagcaaaacaaaacctccatcacatacaaaaaggaaacctcaagacatcaaaaattaaaaaggtgttttagcttgaaagaagcaacaataaaaccaatagctaatttctcaacaaaatgatgaaaaccaggtgacaatagaatgacatctttaagtcagtgaaagaaaataaatgtcaacacataatccttcatcctgc

SEQ ID NO: 54022 - DNA, 398 bp, Homo sapiens
  misc_feature 1, 5, 25, 40, 45, 46, 50, 68, 72, 83, 93, 99, 241, 338, 348,371, 387: n = A,T,C or G
natgngcccctctgcttgcgaagcnttcgaataccgcttnagtannttanaatgaaagtggatgctanggantcgggccgggngagcaaatanggaaangcatatgcagccaaccaaagatgcaaatggttttgaaatgatatgacccaaaattttaaagtaaggaaaggtcacccaaacacttctggctttcacttaagtgtctggcccgcaatactgtagggaacaagcatgatcttgntactgggatattttaaatatccacaggtactcactttttccaaatgatcctaagtaattgcctagaaatatctttctcttacctggtatttatcaanttttcccagnatttttatacgggaaaaaattgnattgaaaacacttagnatgcaggttga

SEQ ID NO: 54023 - DNA, 280 bp, Homo sapiens
  misc_feature 4, 29, 226, 251, 275: n = A,T,C or G
actntagactggacagggaggacaaaaantactgagtgggcccttaaagagggaagtttgttttcaagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgctgggactcacatacataacgngatatatatatatatatataaatgnataaatatatattttatttttttntaaat

SEQ ID NO: 54024 - DNA, 397 bp, Homo sapiens
  misc_feature 6, 15, 205, 236, 240, 277, 302, 309, 374, 376: n = A,T,C or G
ggaaangggcccctngtgtcaacgaaggcttgaaccaacctacggatgactcgtctttgacccctacacagtttcccattatgccggtggagatgagtgggaacgaatgtctgaatcaggctttaaactgttgtgccagtgcttaggctttggaagtggtcatttcagatgtgattcatctagatggtgccatgacaatgggtgngaactacaagattggagagaagtgggaccgncagngagaaaatggccagatgatgagctgcacatgtcttgngaacggaaaaggagaattcaagtgngaccctnatgaggcaacgtgttacgatgatgggaagacataccacgtaggagaacagtgcagaaggaatatntnggtgccatttgctcctgcaca

SEQ ID NO: 54025 - DNA, 381 bp, Homo sapiens
  misc_feature 6, 7, 54, 72, 212, 304, 367, 373: n = A,T,C or G
gcattnnccagctgatggacatttgggttgtttgtactttttggctaccatgantaatgctactatgaactnttgtgtacaaatcttatgtggacttgttttcatttctcttggatgtatattcctaggagaatggctggattatacagtaactctttcctcataactttgcatatcaaaattatatccatctttcagaacccaaattcagngttatttccaaagtgtccaacatctcccactcaaaatgaatcttctccctagtactcccattgtttagtacctaattggtcttaccagttgncttagagctcaagcattcctacacagcacttttcttcattatactgctaattcattacactgnaagagngggacaag

SEQ ID NO: 54026 - DNA, 100 bp, Homo sapiens
  misc_feature 3, 20, 35, 89: n = A,T,C or G
aanagcagacatggaggagnacctgctcctgcagnatttcaagccgcaatctctcggcaagacctccgcgctcttcttcggaaacgcgntcatcgtgtct

SEQ ID NO: 54027 - DNA, 197 bp, Homo sapiens
cgaaatgaccctttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaaggcaaattattttaatattttg

SEQ ID NO: 54028 - DNA, 396 bp, Homo sapiens
  misc_feature 1, 3, 53, 54, 55, 79: n = A,T,C or G
nanttgcccctgggcaggatgaaacaatttggagaagatagaagtttgaagtnnntgctggaagacagacgtacggganggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggaaaagaatagagaagatagggaaattagaagataaaaacatacttttagaagaaaaaagataaatttaaacctg

SEQ ID NO: 54029 - DNA, 109 bp, Homo sapiens
  misc_feature 2, 10, 34, 57, 61, 64: n = A,T,C or G
cnatgaggancgttctcactgacataattggatnacatactaaataagaggatatgntaantangaggaaatgtaaattaaattagttataaataaataaccaaaaatg

SEQ ID NO: 54030 - DNA, 398 bp, Homo sapiens
  misc_feature 1, 11, 30, 33, 36, 47, 51, 53, 57, 62, 67, 229, 375, 393: n = A,T,C or G
ntgcgcattgnctgctctagctctcgaagnatncantacccgctcangatncnaaangaagngaatntaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgntactgtgatattttaaatatccacagtacttactttttccaaatgatcctagtaattgcctagaaatatctttctcttacctgtatttatcaatttttcccagtattttatcggaaaaaatggattgaaaacacttagtatgcagntgataagaggaatttggnataat

SEQ ID NO: 54031 - DNA, 133 bp, Homo sapiens
  misc_feature 6, 9, 69: n = A,T,C or G
atacanccnccatgttgactgtcatgtgcaggtgagaagagaaaaatattttaagaatatgataatttntaaaattgcactaaaataatctttatattgaggcctccggggttttaaaaagtactataatatg

SEQ ID NO: 54032 - DNA, 400 bp, Homo sapiens
  misc_feature 10, 20, 28, 29, 162, 372: n = A,T,C or G
atagggcccntggatccagnataagganngaattgtcctgctggatcaccagagacttgatcttttgctggcaagcagctgggaagatgggacggtacttttggtctggactacaatattcaaaaaggagctactctttcatcttggggttggagacttcgnggtggtgctaaagaaaaggaagaagaagtcttacaccactcccaagaagaataagcacaagagaaagaaggttaagctgctgcctgaaatattataaggtggatgagaatggcaaaattagtcgccttcgcgagagtgcccttctgatgaatgtggtgctggggtgttatggcaagtcactttgacagacattattgtggcaaatgttgnctgacttactggttcaacaaaccagaag

SEQ ID NO: 54033 - DNA, 391 bp, Homo sapiens
  misc_feature 12, 16, 34, 35, 42, 53, 57, 58, 68, 73, 141, 336, 383: n = A,T,C or G
agctaccactgncatnagtcagcaaggcttggtnngatgtgncatcaggaagntatnncaaagcactncgctncctgggatcaaatgatgaggagatgtcctatgacaataatccttttatcaaaacactgtatgatggtngtgcgtccagaaaaggctatgaaaagactgtcattgaaatcaatacaccaaaaattgatcaagtacctattgttgatgtcatgatcagtgactttggtgatcagaatcagaagttcggatttgaagttggcctgtttgcttcttgctaagattaagacgaagaacatatcaaatcaacagaaaatataccttggngccaccaacccattttgtgccacatgcaagttttgaataaggatggnatagaaac

SEQ ID NO: 54034 - DNA, 276 bp, Homo sapiens
  misc_feature 68: n = A,T,C or G
gaagtcccgtaagggtccagctgatcaagaatggcaagaaaatcacagcctttgtacccaatgacggntgcttgaactttattgaggaaaatgatgaagttctggtgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcca

SEQ ID NO: 54035 - DNA, 398 bp, Homo sapiens
  misc_feature 1, 2, 67: n = A,T,C or G
nngaaggatccccctgcggctgaaccgcccggctgagccgacattgccggcgacttgctgattcggnccgacgagctccgttttcgctacagcatggtggcctactggagacaggctggactcagctacatccgatactcccagatctgtgcaaaagcagtgagagatgcactgaagacagaattcaaagcaaatgctgagaagacttctggcagcaaccgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaatcctgcttgtcataaattgacaatgcaataaattgaaatatggtc

SEQ ID NO: 54036 - DNA, 397 bp, Homo sapiens
  misc_feature 1, 16, 71, 362, 381: n = A,T,C or G
nggcagagcctgatgngcatgaacatgaacatagggatgtccgctgctgggatgggcttgacaggcacaangggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctggtttataaaagtgaaatatccagtatttcagagggccagcaagagcacttcagatgagcagncaaaatcattttttccagngagatagcccaagggg

SEQ ID NO: 54037 - DNA, 339 bp, Homo sapiens
  misc_feature 12, 21, 33, 46, 50, 51, 52, 72, 320: n = A,T,C or G
agaacccgagangacgaaggnaacgtcatcgtntggaaagcgtcgnaatnnnacgcacacgatgcgccgccngatgtggctctaaggcctaccaccttcagaagtcgacctgtgcaaatgtggctaccctgccaagcgcaagagaaagtataactggagtgccaaggctaaaagacgaaataccaccggaactggcgaatgaggcacctaaaaattgtataccgcagattcaggcatggattccgtgaaggaacaacacctaaacccaagagggcagctgttgcagcatccagttcatcttaagaatgtcaacgattagncatgcaataaatggtctgg

SEQ ID NO: 54038 - DNA, 375 bp, Homo sapiens
  misc_feature 13, 54, 67, 103, 201, 271, 282, 339: n = A,T,C or G
tgccgaagagganacagcagaaaaaagatgagttgtagacactgatctgctagngctgtaatattgnaaatactggactcaggaacttttgtaggaaaaaatngaaagaacttaagtctcgaatgtaattggaatcttcacctcagagtggagttgaaactgctatagcctaagcggctgttactgcttttcattagcagntgctcacatgtctttgggtgggggggagaagaagaattggcatcttaaaaagcgggtaaaaaacctgggntagggtgtggntcaccttcaaaatggtctatttaacaactgggcatgtcatctggggaaggaagtttntctaccataagtgacaccaataaatggtggtattta

SEQ ID NO: 54039 - DNA, 398 bp, Homo sapiens
  misc_feature 5, 6, 28, 29, 33, 34, 46: n = A,T,C or G
attgnngacagtatcctagatctggacnncagnntactgagaggcnactcagagatgattcagatattgttactactttggatctgcaccgccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccggctccaggagcaagtgatgggagg

SEQ ID NO: 54040 - DNA, 137 bp, Homo sapiens
  misc_feature 6, 9, 11, 13, 15, 31, 33, 40, 89, 119: n = A,T,C or G
tcggangcncnangncgcatgatgcgaaacnancgaaacnccaaaaatgttaatcctgcataaatcaactgtaataataaataggtgtntctgtatagatagaatgcatagagtacctnagtaaatctttgaatcac

SEQ ID NO: 54041 - DNA, 264 bp, Homo sapiens
  misc_feature 1, 4, 34, 36, 63, 71, 83, 102, 124, 130, 146, 159, 224: n = A,T,C or G
nganatcaccgaaatgcttccttttattgtgtangngctattgactttgtttttcaaaacatngtaaaaanagtatctttggnttagtattttggattatanattataatctgaggagtgtttngcttangtaagaatccagatanatttctgttaccnaggagatgttacttacatatgtaatactgtatcctgcacgtggaaatattcagaattgtagatangcataactctccctgctcctattcttttgagcctaggtat

SEQ ID NO: 54042 - DNA, 243 bp, Homo sapiens
  misc_feature 1, 12, 189: n = A,T,C or G
ncgggttagccnacatacctagcacttggtagaataagatttccatcccgagtctgtcttcctccaaagctcatgcttctttgatggagtttggctctgaagtcatggaagaatgaggtgaccttgtaaaacagtgctgatgtgaggatgggtgatcttactgagttctggagctggaactccaatctntagagttctagatgagatggacaacttacatagaaatgtgagaaagaacaggtg

SEQ ID NO: 54043 - DNA, 398 bp, Homo sapiens
  misc_feature 1, 12, 76, 241, 320, 324, 329, 383: n = A,T,C or G
ncgggatagtcnaatgaggtatgcctgtattgctctttctgaagtggtgtgatataaaccatctctaagaaatgtntctaccctaaagatttccccagtacagtcagctctccgtaactgtgggctccacatttagatccaaccagccttggataggaaatatttgaaaaaagaaattgcattggtactgaacacgtacagacctttttttcttgccattattccctaagcaatatggtgnaagcatatttacatagcatttatattggatttggaattataagaaatctagagatgatttaaattatacaggaaggggngcgnagggntacgtgcaaacgctatgccattgcccatcaagggacttgagcatcctcagatgncggtgctgagggttg

SEQ ID NO: 54044 - DNA, 334 bp, Homo sapiens
  misc_feature 9, 11, 30, 148, 332: n = A,T,C or G
gcccagcangnatggaaagttgcctttcgntcctccggagaaagaatttattatgggagtttccaagtatggcataaaagtatcaacatcagatcaatatgatgttttgcacaggcatgctctctacttaataatccggatggtgtgntacgatgacggctggggcgggaaaaagcttactgctctgaagaccacagatgcaagcaatgaggaatacagcctgtgggtttatcaagtgcaacagcctggaacaagccaagccatttgcaaggtttatccaccgcttttgctctgtattaacatctgagaaaccctgaatcctgcaatcaagnag

SEQ ID NO: 54045 - DNA, 164 bp, Homo sapiens
aaatgtttggaaacagtataatttgacaaagaaaaatgatacttctctttttttgctggccaccaaatacaattcaaatgctttttgttttatttttttaccaattccaatttcaaaatgtctcaatggtgctataataaataaacttcaacactctttatgat

SEQ ID NO: 54046 - DNA, 397 bp, Homo sapiens
  misc_feature 1, 11, 56, 59, 387: n = A,T,C or G
ngaagaaaacngaagtgtaggttacggtctgagacatcaccgccaagctgggcatnggngagatggccgagactgaccccaagaccgtgcaggacctcacctcggtggtgcaggacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctgcatttttccaagccaagagaagatcgaatggctttttgcagctaactactatgtgtagacaggntttatattat

SEQ ID NO: 54047 - DNA, 399 bp, Homo sapiens
  misc_feature 10, 18, 27, 29, 35, 67, 69, 91: n = A,T,C or G
agaacccggnattttggnctgaatagncnaagtcntgagctggacttcatgtttccctcaaagactntnccgtggatgacggatgaggacnctggctgctggaataggacactcaagacttttgactgccattttgtttgttcagtggagactccctgccaacagaatccttcttgatagtttgcaggcaaaacaaatgtaatgttgcagatccgcagcagaagctctgcccttctgtatcctatgtatgcagtgtgctttttcttgccagcttgggccattcttgcttagacagcaagcatttgctcctcctttaactgagcatcatcttagtccaactaatgcagcgatacaatgcgtagatagaagaacccacgggagccaggatgggactggtcg

SEQ ID NO: 54048 - DNA, 219 bp, Homo sapiens
  misc_feature 64, 77, 88, 102, 168, 189, 195: n = A,T,C or G
cgggatgtaccttaatttcaaatgcttttttatatctaaaaatatttgagatataatggctttntaaagtaatgctnctatttctttngacaaattgaactntctaaaactaaaaggagtctttttatttttaaaacacaagtagaatgatttaaataggattttaangaatttttggcaaggggctgntttaanttttaaattgagaagtaatatgtg

SEQ ID NO: 54049 - DNA, 119 bp, Homo sapiens
  misc_feature 7, 46, 56, 72: n = A,T,C or G
cagtttngagacatttgttcaatttcccatcgtgcctttccagggnccagtgcagngacagggggagaaggngaggggttaagttaaataaagaagattatttttgtttcctgacttta

SEQ ID NO: 54050 - DNA, 394 bp, Homo sapiens
  misc_feature 3, 14, 25, 48, 66, 72: n = A,T,C or G
ccnaagctaaaggnaaacaaaaganaattaaaaggcacatggacaaancatatgagaataaataantctgtnatcttacattagagaagaacattctaaacataaaaacaaggaaatatattagggaggaaagttgaaataaatatgattatccaaaaatttgaaactatatgataaaataagtggcatcttgaactaagataattgaaatatatatgatatcttaaaagctaattcatttaatatacagtgagtacttttaaattgcacaaaagaaatacatcccaataaagaaaaggttggagggggaggcagaatgagcaaatgatgtgaagaagcaatttatgaaagcaaaataattgtttttaagggtaataagcaaagaattgctaac

SEQ ID NO: 54051 - DNA, 400 bp, Homo sapiens
  misc_feature 10, 18, 46, 98, 191, 309, 388: n = A,T,C or G
tgccgacaanttgcagcngagggcctaggcggctaggtcgggtctntcctttgcagtcggagacctctgccgcaaacatgctccgccagatcatcggncaggccaagaagcatccgagcttgatccccctctttgtatttattggaactggagctactggagcaacactgtatctcttgcgctggcattgntcaatccagatgtttgttgggacagaaataacccagagccctggaacaaactgggtcccaatgatcaatacaagttctactcagtgaatgtggattacagcaagctgaagaaggacgncagatttctaaatgaaatggttcactataacgctgctttaagaatgaagggcttccagaagccacatccgacaattttncacttaaccagg

SEQ ID NO: 54052 - DNA, 397 bp, Homo sapiens
  misc_feature 1, 3, 34, 42, 276, 284, 285, 365: n = A,T,C or G
ngngggaaacccaaatttcctgaattgctatgtngtctgggnttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaccatgtgactttgcacagcccaagatagttaagtgggatcgagacatgtaagcagcatcatggaggtttgaagangccgcatnnggattggatgaattccaaattctgctgcttgctttttaatattgatatgcttatacacttacactttatgcacaaaatgnaggggtataataatgtaacatggacatgactt

SEQ ID NO: 54053 - DNA, 144 bp, Homo sapiens
  misc_feature 5, 13, 33, 57, 74, 139: n = A,T,C or G
agcangcatgcangagatgtgctcgctccgtgnactttagtggtcctgagccgtacngacatgtttctggcctnggaggctatccagcgaactccaaagattcaggtttactcacgacatccagcagagaatggaaagncaaac

SEQ ID NO: 54054 - DNA, 280 bp, Homo sapiens
  misc_feature 4, 21, 79, 205: n = A,T,C or G
tagnccacaggaagacctgcnccactgtcgccttcacacaggcgaactcggaagacaaaggcgctttggctaagctggnggaagctatcaggaccaattacaatgacagatacgatgagatccgcgtcactggggtggcaatgtcctgggtcctaagtctgtggctcgtatcgccaagctcgaaaaggcaaaggctaaagaactngccactaaactgggtaaatgtacactgttgagttttctgtacataaaaataattgaaataatacaaattttcctt

SEQ ID NO: 54055 - DNA, 379 bp, Homo sapiens
  misc_feature 258, 262, 291, 369: n = A,T,C or G
cggggattcctgaagctgacagcattcgggcccgagatgtctcgctccgtggccttagctgtgctcagcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagactngctntcagcaaggactggctttctatctcttgnactacactgaattcacccccactgaaaaagatgagtatgcctgccgggtgaccatgtgactttgcacaagcccaaganaagtaaaggg

SEQ ID NO: 54056 - DNA, 243 bp, Homo sapiens
  misc_feature 6, 10, 30, 43, 51, 57, 66, 70: n = A,T,C or G
aagggnaggntggggggctcctttcccttnagaacttgaagtntctcccantgcctnctctccagnggtntcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcct

SEQ ID NO: 54057 - DNA, 384 bp, Homo sapiens
  misc_feature 2, 6, 112: n = A,T,C or G
gnacancaataatgaaggacctggaccagtgtagagatggcaaagtgggcttccagagcttcttttccctaattgcgggcctcaccattgcatgcaatgactattttgtagnacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttggattggttgcatccccttgccctcaataaataaagtcttttttagttcc

SEQ ID NO: 54058 - DNA, 396 bp, Homo sapiens
  misc_feature 13, 22, 32, 60, 65, 69, 75: n = A,T,C or G
gcggcgaggcccnggaggcagncagccgcagngccttctcgctgagggggcaggcaggantctgngganaccgcngacaacgatgttttctctttgaaagatagagattaatacaactacttaaaaaatatagtcaataggttactaagatattgcttagcgttaagtttttaacgtaattttaatagcttaagattttaagagaaaatatgaagacagaagtacgggaaggcgaagaaaagaatagagaagatagggaaattagaagataaaaacatacttttagaagaaaaaagataaatttaaacctgaaaagtagggaagcagaagaaaaaagacaagctaggaaacaaaaagctaagggcaaaatgtcaaacttaggaagaaaattggaag

SEQ ID NO: 54059 - DNA, 233 bp, Homo sapiens
  misc_feature 12, 13, 28, 32, 34, 43, 67: n = A,T,C or G
ccagaaagaggnnaatggttaggaagtngaangntcgctgatnacctgcacaaccttaataaacgcntccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgg

SEQ ID NO: 54060 - DNA, 397 bp, Homo sapiens
  misc_feature 12, 276, 284, 287: n = A,T,C or G
cggaggctgccngtgggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggncattcagnggngcacccaccacaaggatgaccctcctcctcctgaagatgatgagaacaaagaaaagcgaacagatgatatccctgtttgggaccaagaattcctgaaaggtgaccaagga

SEQ ID NO: 54061 - DNA, 400 bp, Homo sapiens
  misc_feature 11, 16, 336, 371, 393: n = A,T,C or G
ccctcaaagtntttgngacaatggaaaccaaaaaattaattggtaaaccgcttcaaccagcaagacctgttcgtcatctgacttctcccccaggagcagtgttccctttcaaccttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgctgatcatcccattgnactgcaaaaaccagaaaacaaccaaaggtttaagnagcattttaagaacagatgaanttaaggt

SEQ ID NO: 54062 - DNA, 280 bp, Homo sapiens
  misc_feature 1, 56, 60, 79, 113: n = A,T,C or G
ngaagggagccgcaaacgggcataaattccagggaccactgggtgagagaggaatnaggnccagagcgaggaaaggatnttaccaaagcatcaatacaaccagcccaaccatnggtccacacctgggcatttggtgagagtcaaagctgaccatggatccctggggccaacggcaacagcatgggcctcacctcctctgtgatttctttctttgcaccaaaggcatcagtctccaacatgtttctgttttgttgtttgattcagcaaaaatctcccagtg

SEQ ID NO: 54063 - DNA, 299 bp, Homo sapiens
  misc_feature 9, 14, 75, 101: n = A,T,C or G
cattttggngcggnctaggccggagcatacttgtacaaatattttgcacttcaaccagatgacgtgtactactgnggaataaaggacatcaaagatgatgncatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgtcatgactttaacaagaaacttacagcctatttagatcttaacctggataagtgc

SEQ ID NO: 54064 - DNA, 273 bp, Homo sapiens
  misc_feature 14, 16, 28, 38, 39, 53: n = A,T,C or G
aaagaaggagattngnggaattcataantatgtggaanntaaacagcacactnctaatacaaataggttgaagaagaaatcacgttgcttcatggccttttggctaagttcgagtgtagtatctgtccttatcagtttaatatctgatacatcctctatctgaggacaatacattaaagggatttttggagcagggagatggaataaggactagtttcctccactccatgcatcaacctggtattgcagtacctccagaaatggtgcacccct

SEQ ID NO: 54065 - DNA, 346 bp, Homo sapiens
  misc_feature 286, 336: n = A,T,C or G
gctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacatttttttcccaagacccttcattctcttaaataactttaattttatgaaaccatgtatactaaagaaaaacttttccaagattccaggtgattgtgcatttgtgctctaatctacttttttaacattacggctaatctnttgcgtagacatatcgtgtggaataactgccatatttcaagagtcctcanggttcctttt

SEQ ID NO: 54066 - DNA, 120 bp, Homo sapiens
  misc_feature 7, 26, 34, 44, 67, 98: n = A,T,C or G
caggccntttcggtacaccagcatcnaacgtgantgtttatcgnctatcctccccggatcaccagcnagcccaccccggtcatctacacccggccggnaacaccgtgaaactgaactgca

SEQ ID NO: 54067 - DNA, 344 bp, Homo sapiens
  misc_feature 7, 12: n = A,T,C or G
aaatttnttggntgaaaaatacatccgcagggttcgggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgaccttcttctt

SEQ ID NO: 54068 - DNA, 397 bp, Homo sapiens
  misc_feature 1, 19, 29, 39, 78, 362: n = A,T,C or G
ngaatgcccgtgtagttantcacaggtgnattctgtgcncgtgtgcacgagagattcctaaacgggaaaaggactggnaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaacacctgccatctacaaattacaaggctggataacagctcactccatttgaaattcagtggaaacccaagagctaggttcttactgaatttgcatctcaatttgggaaactgacttagcttcaaagatcataggaagnctggttggaggaaactagggatattctgcaatggg

SEQ ID NO: 54069 - DNA, 311 bp, Homo sapiens
  misc_feature 2, 4, 27, 28, 47, 54, 68, 70, 283: n = A,T,C or G
tngnatggcatgcctgtgcgcaaggcnnagcgtaaagtctagaaaanaatgcanagggcacggctacncnatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctaagttcagaaggaagcaaaatcccttaatctatgtgcaccgntgggaccaatgccttaattaaagaattt

SEQ ID NO: 54070 - DNA, 147 bp, Homo sapiens
  misc_feature 5, 9, 11, 14, 16, 17, 30, 52, 63: n = A,T,C or G
actgntgcntnganannaaaaagatactgntttggggcaatgaggaatattngacaattaagntaatcttcacgtttttgcaaactttgatttttatttcatctgaacttgtttcaaagatttatattaaatatttggcatacaagc

SEQ ID NO: 54071 - DNA, 398 bp, Homo sapiens
  misc_feature 258: n = A,T,C or G
atcagcagggtccctacgcagacaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgctgggnctgctctctcccaggaattctcatgtgggattccccttgccaggatggcctttggatctctcttccaagcctttcctgacttcctcttagatcataagattggacctggttttgttttcctgcagctgtgactttgttgc

SEQ ID NO: 54072 - DNA, 176 bp, Homo sapiens
  misc_feature 9, 16, 49, 60: n = A,T,C or G
tcccgatanttgctgncgatggagtagaattgatcaggtttaagacatnctgctcaggtngggcatagaggctcatgcctgtaatctcagcactttgggaagccaaagtgggaggattgcttgagcccaggagttccaaaccatcctgggcaacagagggagaccctgtctctacc

SEQ ID NO: 54073 - DNA, 397 bp, Homo sapiens
  misc_feature 4, 17, 45, 77, 295: n = A,T,C or G
cganggctgccagcggngttgtagttaagctcgtgtaacggcggnggtgtcaggctgctgctgtagcgaagagagtntggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctgcagacctcagctgcctggnttaccgagctgatacccagacataccagccttataacaaagactggattaaagagaagatctacgtgctccttcgtcgcagcccaacagctgggaaataatt

SEQ ID NO: 54074 - DNA, 217 bp, Homo sapiens
  misc_feature 6, 19, 63, 81, 89, 103, 114, 119, 143: n = A,T,C or G
cagccntgattgaatgttngctgaagttttgtctcttggtccacagtatttggaaaggtcacngaaaatgggtctttcagncttggcanttcatttaggatcnccatgagaaangggcntcttgagccctgaaaatgtatatngtgtgtctcatctgtgaactgctttctgctatatagaactagctcaaaagactgtacatatttacaagaaactt

SEQ ID NO: 54075 - DNA, 400 bp, Homo sapiens
  misc_feature 4, 20, 35, 55, 68: n = A,T,C or G
ccgnagatgtgctcgctctnaaaagacaaactgancggggaaagacaatcattgnatacaaaacaaanaagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtggcaaaagagaaaaagaaggattgatcagagcattgtgcaatacagtttcattaactccttcccccgtcccccaaaaatttgaatttttttttcaacactcttac

SEQ ID NO: 54076 - DNA, 304 bp, Homo sapiens
  misc_feature 14, 19, 34, 36, 38, 40, 43, 47, 48, 54, 57, 301: n = A,T,C or G
atccgatgaagcanagatnccttatattatcaananananatnctannggaacnaanatataaggatttcaggagacatgataggaagtgtaactttgtttccaaaaagtgtaaattaaaacattaggaagagaaagaaagagaaacgttaatatctaattcaggttcaagtacagtaaaaccagttctaatatattgctggagtccttacagattagcatatagcccttttgttgagaatttggaaatatgccaaaatccataaaaatactgatttcttttgactaagaatttccagtgnagg

SEQ ID NO: 54077 - DNA, 191 bp, Homo sapiens
  misc_feature 7, 10, 55, 83, 101: n = A,T,C or G
agagagntancattggcatgccacagggggacctcctcgcttcatcctgtaaagntcaacaataaaaaccaaattatggggcngcttttgcacactagcanagagaatgtgttgaaacttaactttgtaagcttgtatgtggttgttgaccttttttttccttacagacacccataataaaatatcatact

SEQ ID NO: 54078 - DNA, 397 bp, Homo sapiens
  misc_feature 4, 56, 267, 270, 317: n = A,T,C or G
cggnggcgcccaggcccgtggatctcatcgaagatggcggcggcgatctgtgtcgncattaccagaagagtcttcatgtggacagtctcaggggcaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagttttnggncatctcttcctagtaattggcaagacatctccctggaagatagtcgnctaaagtcaatcttctgctcatttagctgatgacttgggcatgtagtccctactccagactccaccagatgtgcagggtt

SEQ ID NO: 54079 - DNA, 268 bp, Homo sapiens
  misc_feature 4, 5, 83, 86, 138, 159, 197: n = A,T,C or G
aganncctgcttaaaatttctacaaatgggaacattaggaaaggacaatctatttcatttttaattaggtcatccttggaagnaanagtttgaataattaattgaacaaaaagtgcctgttattttccattccatggncccagttttgacctctgcagntaaaagttaagcctaatcagctttccacaggatgcagntgcatggttaaagataggtatcatgccctctgggaagatttttttttctttggatcaatatctttaaagtg

SEQ ID NO: 54080 - DNA, 225 bp, Homo sapiens
  misc_feature 1, 3, 36, 41, 53, 78: n = A,T,C or G
ngnaaactccaaaaggagacattggagaagaaccangctgngtctataagganttgcacatgagatggcacacatatntatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttt

SEQ ID NO: 54081 - DNA, 396 bp, Homo sapiens
  misc_feature 7, 311, 317: n = A,T,C or G
attgacnacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctntatatngaaaaaagatgcagtcaaagcttttcagacatgcccaactttgagaatttcttcaccatctaatgctataaagattttg

SEQ ID NO: 54082 - DNA, 373 bp, Homo sapiens
  misc_feature 21: n = A,T,C or G
cgagaacccggccattttggncgggtgcccctccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttg

SEQ ID NO: 54083 - DNA, 304 bp, Homo sapiens
  misc_feature 1, 57, 58: n = A,T,C or G
ncgggatacccagaaaggttgggaaagcaccaaaatctgcatgtggtagtgtgcccnngcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgc

SEQ ID NO: 54084 - DNA, 213 bp, Homo sapiens
  misc_feature 6, 16, 62, 69, 75, 78: n = A,T,C or G
cactcnccagaaatgnttgccatatgcttcttgcaatgcatattttttaatctcaaacgttncaataanaccatnttncagatataaagagaattacttcaaattgagtaattcagaaaaactcaagatttaagttaaaaagtggtttggacttgggaacaggactttatacctcttttactgtaacaagtactcattaaaggaaattgaatg

SEQ ID NO: 54085 - DNA, 135 bp, Homo sapiens
  misc_feature 13, 14, 35, 42, 52: n = A,T,C or G
aacgctgcactgnngctaccttctgctatccctgnaaaggangaatgtacancatgttgacaagcctattttcaagttatttgttggttgtttgcttgtttttgtttttgcagctaaaataaaaatttcaaatac

SEQ ID NO: 54086 - DNA, 344 bp, Homo sapiens
  misc_feature 2, 4, 30, 37, 88, 104, 209, 276, 280, 339: n = A,T,C or G
cncnatgtctacaaaattggtggaattggnactgatnctgttgccgagtggagactggagttctcaaacccggtatggtgggcacctntgctccagtcaacgtnacaacggaagtaaaatctgtcgaaatgcaccatgaagctttgagtgaagctcttcctggggacaatgtggcttcaatgtcaagaatgtgctggcaaggatgtcgncgggcaacgttgctggtgacagcaaaaatgacccaccaatggaagcagctggcttcactgctcaggngatnatcctgaaccatccagccaaataagcccgctatgcccctgtattggattgccacacggntcaca

SEQ ID NO: 54087 - DNA, 300 bp, Homo sapiens
  misc_feature 29, 46: n = A,T,C or G
acagaggtaaatgaattatctgacaaagnaattcaaaatgatcatnttaaagaagcttagtatgctgtgagagaacagagatagtcaagcaaatgaaatcagaaaaaatgcaataacaagaatatcaacaacaagacagaactataaaaaaagaaccatacaaattctgcatctgagaaataactgaattgaaaaattaactagagggattaaaaagctgacccagtcatgcagaagaatcgtcaaactcaacagctcatttaaattgatcaaatcaaaaaaaaaaaaaaaaaaaaaaaa

SEQ ID NO: 54088 - DNA, 364 bp, Homo sapiens
  misc_feature 303, 317, 325: n = A,T,C or G
atgataattaaattaaaacactagtttgttcacttgtaggactgcagttctgaattttgggttaaaggttttggctgctgtaagaatgtgaatttgaatgtattttgaattgtaagagcaaaagaacgtttttgtacaatttttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagnggtttcacaacagntctcttgnatttatttatcaattaaatcgaataaaaatgattatgcc

SEQ ID NO: 54089 - DNA, 180 bp, Homo sapiens
  misc_feature 48, 61: n = A,T,C or G
tgggaaaacacattgatttttaagaatctctaatgaaatgtatgtacnatattttgttggnctgtaagcattttatttaccaaatattcaaagactttttctgtgtttttaattttcaagtacttcttttatagacataagttcctttgtactgactaagatcagtgtagttttgttttg

SEQ ID NO: 54090 - DNA, 338 bp, Homo sapiens
  misc_feature 48: n = A,T,C or G
agtggttggatggcaagcatgtggtgtttggcaaagtgaaagaaggcntgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccccttgggttccatgttttccttgttccctcccatgcctagctggattgcagagttaagtttatgattatgaaataaaaacta

SEQ ID NO: 54091 - DNA, 400 bp, Homo sapiens
  misc_feature 53, 105, 204: n = A,T,C or G
tcatgaaacaaccccaaataaaggaagtggaaccacttcaggtactacccggnttctatctgggcacacgtgtttcacgttgacaggtttgcttgggacgctagnaaccatgggcttgctgacttagccaaagaagagttaagaagaaaatacacacaagtatacaggctgttcctagtttcttagacttatctgcatattggntaaaataaatgcaattgtgctcttcatttaggatgctttcattgtctttaagatgtgttaggaatgtcaacagggcaaggagaaaaaaggcagtcctggaatcacattcttagcacacctacacctcttgaaaatagaacaacttgcagaattgagagtgattcctttcctaaaagtgtaagaaagcatagagatt

SEQ ID NO: 54092 - DNA, 431 bp, Homo sapiens
atattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctg

SEQ ID NO: 54093 - DNA, 410 bp, Homo sapiens
aacggaaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgcttgagctgaaggaaaagattgatcgccgttctggtaaaaagctggaagatggccctaaattcttgaagtctggtgatgctgccatttgttgatatggttcctggcaagcccatgtgtgttgagagctttctcagactatccacctttg

SEQ ID NO: 54094 - DNA, 250 bp, Homo sapiens
  misc_feature 202, 211, 237: n = A,T,C or G
aatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgngttttcctntctgaatctgtcatgaacacgttggntggctgggttcag

SEQ ID NO: 54095 - DNA, 300 bp, Homo sapiens
  misc_feature 199, 200: n = A,T,C or G
tttaaggaaaatacagtccttggtaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgnngaaaataattctttgagacagatttcagctacctcccttccaggttcgatttaacttggttgtaattgtcaatttgttgttataggtcttacctgtgtga

SEQ ID NO: 54096 - DNA, 400 bp, Homo sapiens
  misc_feature 24, 335: n = A,T,C or G
tgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaatagataaaaggtttctaaaacatgacggaggttgagatgaagcttcttcatggagtaaaaaatgtatttaaaagaaaattgagagaaaggactacagagccccgaattantaccaatagaagggcaatgcttttagattaaaatgaaggtgacttaaacagcttaaagtttagtt

SEQ ID NO: 54097 - DNA, 270 bp, Homo sapiens
atgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacattccaaaaaaaaaaaaaaaaa

SEQ ID NO: 54098 - DNA, 300 bp, Homo sapiens
  misc_feature 52, 53: n = A,T,C or G
actggcagtggcatcagcgatggcggctgcgtcggggtcggttctgcagcgnngatcgtgtcgccggcagggaggcatagcgcctctctgatcttcctgcatggcttcaggtgattctggacaaggattaagaatgtggatcaagcaggttttaaatcaagatttaacattccaacacataaaaattatttatccaacagctcctcccagttacactgttggaccaagttttgccagatcatatactcctatgaaaggaggaatctccaatgtatggtttgacagatttaaaataaccaa

SEQ ID NO: 54099 - DNA, 317 bp, Homo sapiens
  misc_feature 27: n = A,T,C or G
agtctttgaatatcgaacacgcaaggntgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgc

SEQ ID NO: 54100 - DNA, 340 bp, Homo sapiens
agacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaa

SEQ ID NO: 54101 - DNA, 510 bp, Homo sapiens
aatggaatggaatggaactgaatggaatggaatggacttgaatggaatagaatggaatggaatggaatggactcgaaagaaatggaatggaatggattcaaatggaatggaatggacacaaatggaaccaaatggaatggaatggactcgaatggaatacaatggaatttaatggaatggactctaatggaatggaatggactagaatggaatagaacggaatagactcgaaaggtatggaatgcaatggaatggactcgaatggaatagaacagaatagactagaatggtatggaatgcaatggaatggacaagaattgaatggactggaatggaatggaatggaatgcaatggaatgccattgaacggattggaatggaatggaatggaacggaacggaacggaacggaacggaacggacccggaatggaacggaacggacccggagtggaacggaacggacccggaatggaacggacggaatggaatggaatggaatggatgaagtg

SEQ ID NO: 54102 - DNA, 176 bp, Homo sapiens
aatgagttgaaatgttctgtcaaatgtgtctcacatctacacgtggccttggaggcttttatggggccctgtccaggtagaaaagaaatggtatgtagagcttagatttccctattgtgacagagccatggtgtgtttgtaataataaaaccaaagcgaaaaaaaaaaaaaaaaaa

SEQ ID NO: 54103 - DNA, 228 bp, Homo sapiens
agtaaaagtactggttaatgataacaatgcatcgtaaaaccttcagaaggaaaggagaatgttttgtggaccactttggttttcttttttgcgtgtggcagttttaagttattagtttttaaaatcagtactttttaatggaaacagcttgaccaaaaatttgtcacagaattttgagacccattaaaaaagttaaatgggaaaaaaaaaaaaaaaaaaaaaaaaaaa

SEQ ID NO: 54104 - DNA, 160 bp, Homo sapiens
tggaatttgatattccagcacaaagtccacagtgtattcagaaatccaagttggtgtcatacatttcattttgatgtgaacttttctttgctttcctttgttctaagactccattttgcaataaacgttttgacaaaaaaaaaaaaaaaaaaaaaaaaaa

SEQ ID NO: 54105 - DNA, 360 bp, Homo sapiens
  misc_feature 153: n = A,T,C or G
agatggagcagcacttagtgcttcatagaaagcaatgcctatttttaaggttacaaacgcagatatctacatagatatgctttgctgagaagttaggtctgtggtagaccagaaaccacaaattgactttttttcttagaaaatatttctatnttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggcttgtcagagctcttgcagatactgtgttcactaaataaaaatcacatgtattg

SEQ ID NO: 54106 - DNA, 324 bp, Homo sapiens
tctattggaatcatcttaaatcgaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcccaaaaaaaaaaaaaaaaaaa

SEQ ID NO: 54107 - DNA, 135 bp, Homo sapiens
agcgctcatagcgaaagcctactgtaatatgcacccatctcatccacgtagtaaagtgaacttaaaaattcaatcaaatgaacaattaaataaacacctgtgtgtttaagacatgaaaaaaaaaaaaaaaaaaaa

SEQ ID NO: 54108 - DNA, 530 bp, Homo sapiens
  misc_feature 495: n = A,T,C or G
agtgtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgagggaggttgttttagctctgctaaaaactccagcgcaatttgatgctgatgaacttcgtgctgccatgaagggccttggaactgatgaagatactctaattgagnatttttggcatcaagaactaacaaagaaatcagag

SEQ ID NO: 54109 - DNA, 440 bp, Homo sapiens
  misc_feature 421: n = A,T,C or G
taggttaagttttgttagtgttcccagaaatatactgaattgagggataatgtagctttaaagaaattatgtttctttttaacatttggagaagccacctgtcctgggtccctattcttgagaaattcatcttttcatgcaaataacattgatgggggacaagactggatgattgacttctatcagtcagtagacaaggaagtataataattgccaaaggtgagggtaattttgccttacaagtatgtaggtcattctgtggtgggatttcccatcacatctagtaaaaaacaaccttttcatttccctcctttctaatccaagatcatatttttaaaaagtaggtttctgatgtgccatgaaatatttctgtgaatctgtgtttttgaccaaggaaacagctgagatattaaaccatgtngggtgttccacgggtcatc

SEQ ID NO: 54110 - DNA, 151 bp, Homo sapiens
  misc_feature 49: n = A,T,C or G
tgctggggatggcagtgggtgtcgatgatatgtccacggctgagcaggncttgtatccgaagcttgaagtaaccatgccaccatttatcatcaaatttgaaccttttaataaaattaaacagcctaaaaaaaaaaaaaaaaaaaaaaaaaa

SEQ ID NO: 54111 - DNA, 400 bp, Homo sapiens
gtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaa

SEQ ID NO: 54112 - DNA, 233 bp, Homo sapiens
tgggaggtagaggagggcagatatctgaagtaggagttccagaccagcctggccagcatggtgaaaccccgtctccactgaaaatacaaaaattgactgggcatggtgtcgcacgcctgtagtcccagctactcgggaggcggaggttgcaagtgagccaagactgtgccactgcactccagcctgggcaacagagcgagaccctgcctcaaaaaaaaaaaaaaaaaaaaaaa

SEQ ID NO: 54113 - DNA, 400 bp, Homo sapiens
  misc_feature 276: n = A,T,C or G
aacatgaagacataccaaactgcaaataggattatttttcaaaactatatggtgaaacatatggtgatatgatagacttatggtttttctgtttgctgggattgggtctgctttttgcctatgtgtaaggcattttaatcattgtgaatataatagattccttaaaataagaaaattaaaaatcagaaacttcccttggagtagagacatttcagttgcaagcataaagatttttaaatatataacactaggttatataattcatatatgtgtggntttgtattaataatcaaattaataaaaacatttcattttctaccattgtatgaacgtaattttattttttaataaccacactcatagatggttttgattgttccagttgagtgattgtgtatgt

SEQ ID NO: 54114 - DNA, 128 bp, Homo sapiens
actggtggctaggtctccccttatccttctggtccagcgcaaggaggggctgcttctgaggtcggtggctgtctttccattaaagaaacaccgtgcaacgtaaaaaaaaaaaaaaaaaaaaaaaaaaa

SEQ ID NO: 54115 - DNA, 400 bp, Homo sapiens
  misc_feature 51, 93, 371: n = A,T,C or G
atttaaagaaatatttttaaagtccacaattattttaatattggatatcanctgcttgtaaaggtgctcctcttttttcttgtcattgctggncaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggntgttgatcttttttttccttacagacacc

SEQ ID NO: 54116 - DNA, 340 bp, Homo sapiens
  misc_feature 17, 21, 23: n = A,T,C or G
gtcactgcctcccgaantgcncngaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcaggaaataaattgctta

SEQ ID NO: 54117 - DNA, 420 bp, Homo sapiens
  misc_feature 21: n = A,T,C or G
atgaaaaaagagctttcaagnacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaaatgatggc

SEQ ID NO: 54118 - DNA, 288 bp, Homo sapiens
  misc_feature 10, 22, 215, 285, 286: n = A,T,C or G
tgggccgggnaaggccatcagnaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggnccagtgttcatctgagcataactgtactaaatcctttttccatatcagtataataaaggagtgatgtgcnntg

SEQ ID NO: 54119 - DNA, 116 bp, Homo sapiens
ggtgacggggaatcagggttcgattccggagagggagcctgagaaacggctaccacatccaaggtaggcagcaggcgcgcaaattacccactcccgacccggggaggtagtgacga

SEQ ID NO: 54120 - DNA, 100 bp, Homo sapiens
  misc_feature 12, 13, 30, 54, 58, 59, 64, 65, 89, 90, 91, 92: n = A,T,C or G
gaaaaaaaaaannaaaaaaaaaaaaaaaanaaaaaaaaaaaaaaaaaatttttngggnnccccnngccccccctttttttttttttggnnnntttttttt

SEQ ID NO: 54121 - DNA, 100 bp, Homo sapiens
  misc_feature 22, 24, 27, 38, 41, 42, 51, 53, 55, 62, 69, 71, 74, 75, 83,84, 88, 89, 90, 91, 93, 96: n = A,T,C or G
tttaagaaaaaccccgtggatncngtntatactgtcgnttnnctgtttganananaccaganttaggtncnacnncttaaaanntatnnnntntangctg

SEQ ID NO: 54122 - DNA, 391 bp, Homo sapiens
  misc_feature 5, 22, 29, 50, 63, 67, 81, 100: n = A,T,C or G
cactncaataatttgtctactntctagcnttcactttacaaagagttctntaaaaacacctantaantaggtactttagantttcacaacttacttaganactttgtcacttacttccccttcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaata

SEQ ID NO: 54123 - DNA, 261 bp, Homo sapiens
  misc_feature 11, 12, 17, 28: n = A,T,C or G
tgggaaaaacnnttgtnaagaaagatcncagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgc

SEQ ID NO: 54124 - DNA, 392 bp, Homo sapiens
  misc_feature 5, 16: n = A,T,C or G
gaganctgaacctganttgtgtgtgcaccgcgtctccagcgatcccggatccactgcgctgccaggggcctgggggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgata

SEQ ID NO: 54125 - DNA, 389 bp, Homo sapiens
  misc_feature 18, 20, 44, 50, 51, 72, 74: n = A,T,C or G
aaaccgggatggtcccgnancccctggaattagtaatttgtttntcccgnntctcatggttttgatatttancnagaatttgctttgtgacattactttgataatttgcaatcacgtatgtcctattgttaataacattgttgaaatgggtgtatacttacttgatttgaaatataagggaagtgttgggatatgtgttttctgttggatttggacgtggagtttcttgggttactgatttaaaggtgatcgtgtttggaccatactcttgaatttttgcctgaatcagtatgggaagtaaatatattgtgattatgagaagtttctttggggggaggagtgtaatattttcaagggtatataatgggttaaagaattttgtgaaagac

SEQ ID NO: 54126 - DNA, 140 bp, Homo sapiens
caaatttcaaagttacgtaatacttttatttaaaaagtgaaacaaagcttttcctctcctttacccacatgttagtccagcagagggggaaagcattggccccaggccaaaatcataaacgctttcaattaactaataat

SEQ ID NO: 54127 - DNA, 381 bp, Homo sapiens
  misc_feature 343: n = A,T,C or G
aggccacacccactccttttgggaaagaccaagattggccagctctagctgtggatttagcccatcaccttcaagttagtgaagatgttgttagaaggcattatgtgggggaactatacaactatggagttgaccacttaggagaagaggtaatcatgaccctttgaatgttaattgggctcaagttataaaattgatagttggaataaagaatcagttaagtttccaatgaagccttttgctcttccttttattagaacatctaggtataaaaatagaacaatagaatattttttaaaacataaaattataatcaaataattcctacagtgtgccaggcctncccctacgcacagggatatagcagtaaaaaaaaaaaaa

SEQ ID NO: 54128 - DNA, 204 bp, Homo sapiens
aaactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctcccaaaaaaaaaaaaaaaaaaaaaaa

SEQ ID NO: 54129 - DNA, 310 bp, Homo sapiens
  misc_feature 104, 114, 157, 203, 238, 241, 279: n = A,T,C or G
caggattttcttttagctctgtcaaggactggaacctagactgtcaattataatgaaaatacattttcattagttgttccttttctgtatgcctttagtagtgnatcaagttgnttatagagaatgcaaaatcataaaggtatagttgccttgctgnttgagacttcccaatatgatttttttattcttgaattttgctaggnaccttcaaattccattctataacttcatttaatgnagnatagatgctggcttcattataaaagccattctccttanaagggaaaatgtctccgtaactgtcatgttt

SEQ ID NO: 54130 - DNA, 291 bp, Homo sapiens
  misc_feature 15, 206, 261: n = A,T,C or G
gtcgcggggagggancaaatgtagtactgagggaagaaaaaaaatctcttttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgnagtgagggtcaaaggagagtcaacatatgtgattgttccataataaacttctggngtgataaaaaaaaaaaaaaaaaaaaaaaaa

SEQ ID NO: 54131 - DNA, 370 bp, Homo sapiens
ctaaaatccaagcaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcacctgttgtgaggaaaaattacctgtcttgactgccgtgtgttcatcatcttaagtattgtaagctgctatgtattggatttaaaccgtaatcatatctttttcctatctgaggcactggtggaataaaaaacctgtatattttactttgttgcaagatagtcttgccgcatcttggcaagtt

SEQ ID NO: 54132 - DNA, 400 bp, Homo sapiens
tattatggtagtagaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactggggttgaccctaaccaaggatgcaaattggatgctatcaaggtattctgtaatatggaaactggggaaacatgcataagtgccaatcctttgaatgttccacggaaacactggtggacagattctagtgctgagaagaaacgcgtttggtttggagagtccatggatggtggttttcagtttagctacggcaatcctgaacttcctgaagatgtccttga

SEQ ID NO: 54133 - DNA, 397 bp, Homo sapiens
  misc_feature 242: n = A,T,C or G
tctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggngaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaatt

SEQ ID NO: 54134 - DNA, 394 bp, Homo sapiens
  misc_feature 1, 10, 371: n = A,T,C or G
naattcggcnttatggcccgggggaggcattgaggcagccagcgcaggggcttctgctgagggggcaggcggagcttgaggaaaccgcagataagtttttttctctttgaaagatagagattaatacaactacttaaaaaatatagtcaataggttactaagatattacttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccantagaagggcaatgcttttagatt

SEQ ID NO: 54135 - DNA, 360 bp, Homo sapiens
  misc_feature 55, 205, 331, 336, 358: n = A,T,C or G
ccccggctgagccgacattgccggcgtcttggcgattcggcccgacgagctccgntttcgctacagcatggtggcctactggagacaggctggactcagctacatccgatactcccagatctgtgcaaaagcagtgagagatgcacctgaagacagaattcaaagcaaatgctgagaagacttctggcagcaacgtaaaaattgngaaagtaaagaaggaataatctaccctgactaaagcttgaaatgctacatttccaaggtgaagatgtgtgggcacatgttatgggcagattgaaaaggatctcattccatgggaaaaaaaaaaaancctgncttgttcataaattgacaatgnca

SEQ ID NO: 54136 - DNA, 193 bp, Homo sapiens
  misc_feature 32, 42, 44, 48, 51, 59, 63, 66, 69, 71, 94, 132, 137, 184,186: n = A,T,C or G
ataatttccttggtttctgttaccactgttanagggagttgnancctntancatatagnaggntanttnangtgacgggaggacaattattgtntgaagctaaaatgggttattcataggactgatggaaangattncatctctgccatctctaaagcacttttcattgaacatgtatgcctangntacgtac

SEQ ID NO: 54137 - DNA, 372 bp, Homo sapiens
gggacaactcggtggtggccctgcgcagaccagacttcgctcgtactcgtgcgcctcgcttcgcttttcctccgcaaccatgtctgacaaacccgatatggctgagatcgagaaattcgataagtcgaagctgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaagg

SEQ ID NO: 54138 - DNA, 146 bp, Homo sapiens
gatgctgtattttctccttttacagagaggaagtagagcctcagagatgttatgtcacttgtcaaaagtcacccagctagtgaatggctggatcaaactggatcatgtccaagtagcctggcttcaaagttcacacgctttactat

SEQ ID NO: 54139 - DNA, 400 bp, Homo sapiens
  misc_feature 2, 334: n = A,T,C or G
tnagggagcatttccctttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggngttcaaaacagaactgtatttttgcctttaaaattaaataatataacgtgaataaatgaccctatc

SEQ ID NO: 54140 - DNA, 358 bp, Homo sapiens
  misc_feature 1, 7, 83, 86, 104, 220: n = A,T,C or G
ngttccnaaaaattttgacagggatatgaatagattggaagaaagatatggtatggcttgcagctccacaggcctacgtgagnganaaacatgaaggcaactangatcattgcttttgaaagagcaggtcttcttttcattttcaacttccatccaagcaagagctacactgactaccgagttggaacagcattgccagggaaattcaaaattgtgctanattcagatgcagcggaatattggagggcatcagagactggaccacagcactgactttttttctgaggcttttgaacataatgggcgtccctattctcttttggtgtacattccaagcagagtggccctcatccttcag

SEQ ID NO: 54141 - DNA, 386 bp, Homo sapiens
  misc_feature 23, 36, 376: n = A,T,C or G
caggaagcaactggctacaaaanccgctcgcaagantgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagcttatcggtgctttgcaggaggcaagtgaggcctatcttggttggcctttttgaagacaccaacctgtgtgctatccatgccaaacgtgtaacaattatgccaaaagacatccggctagcacgccgcatacgtggagaacgtgcttaagaatccactatgnatgggaaaca

SEQ ID NO: 54142 - DNA, 360 bp, Homo sapiens
gagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattgg

SEQ ID NO: 54143 - DNA, 226 bp, Homo sapiens
  misc_feature 4, 10, 13, 22, 33, 47, 54, 59, 114, 115, 133, 162, 165, 189: n = A,T,C or G
tgtntttctnttnactgtgtanctttctactgntctgatctcactgntttatgncgctnttccataggtgcatgtttgcataatacagtggatctgaatttattattgcttatnnaacacatttgatggcttnaggagtacttggttatttcataatggtcnacnaatgaaaccagctgtggatttcanaacacagtgtattctagatcatctaagatccatgctg

SEQ ID NO: 54144 - DNA, 286 bp, Homo sapiens
acactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttggtatcttaataaatattataaaaatgtc

SEQ ID NO: 54145 - DNA, 400 bp, Homo sapiens
  misc_feature 25, 176: n = A,T,C or G
gacatgcctcctttgacgttagacngcatccaggaccgtgttctttacgtattgaaactctatgacaagattgacccagagaagctttcagtaaattctcattttatgaaagacctgggcttagacagtttggaccaagtggagattatcatggccatggaagacgaatttggggntgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgt

SEQ ID NO: 54146 - DNA, 388 bp, Homo sapiens
  misc_feature 1, 55: n = A,T,C or G
nagcctaagttgattaaaaatgcttttttaatgcaggagcctacttctagctgcnttttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgaca

SEQ ID NO: 54147 - DNA, 283 bp, Homo sapiens
  misc_feature 23: n = A,T,C or G
aatcctcagaaagtgggtaaagntcatacgttggaggatgaggatgtccttcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgc

SEQ ID NO: 54148 - DNA, 132 bp, Homo sapiens
  misc_feature 22, 23: n = A,T,C or G
cttctttgtggcggtgcctgcnncagtgactttcttggatcgggtcgcctgtgtggcaagagtagaaggagcatcgatgcagtcttctttgaatcctggggggagccagtcatctgatgtggtgcttttgaa

SEQ ID NO: 54149 - DNA, 451 bp, Homo sapiens
  misc_feature 26, 233, 277: n = A,T,C or G
tttgtgaatttttcttggccctctgngagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctnatcatctccttacagccagactggagcttccaaggacatcaggntgcaaggattgtgagtaccctaaacatctaaagagtccctctaataagggacatatttgttcttcaacagtttcctaacttgagaccacaaatgcgtaatctctctaatatcctaaagcttggcaaactgggcagcccctgagcagaccgcacagagcttaaatgcagtgcttt

SEQ ID NO: 54150 - DNA, 263 bp, Homo sapiens
  misc_feature 28, 65, 107: n = A,T,C or G
ggaagttgaagaagatgccagttaaagnccttaacaataaatggtaaggagcagctgctgcactnggataacacgtaattcaacgcacgcacttaacagaaatgttnaactataacaagcaccatttgaggattaacaggaacatttttttgaagatttcaaacgaactcgactttcagtataattgtacctaaagtatttataaacagctcatcggagcctctatttgcatagacttttgagttgattgtgggaccacataa

SEQ ID NO: 54151 - DNA, 210 bp, Homo sapiens
  misc_feature 33, 51, 62, 154: n = A,T,C or G
tgtttgcaaaggggaggcatcagtgtccttggnagctgatttctaggtagnaaatgtggtancctcacttttaatgaacaaatggcctatattaaaaactgagtgctctatatagctgatcaggtttttcacctggaagcatttgttctacttngatatgctgttttcggacagtttatttggtgagagtggtgaccaaaagttacatgt

SEQ ID NO: 54152 - DNA, 445 bp, Homo sapiens
  misc_feature 40, 290, 308: n = A,T,C or G
gactctgcattgaaaacacagatgagcctttggatgtggnaatttacaaggctcagagagccccgaaacatcttcagaagtggagcccagcagaataatgggaggctgtgtgctggcttgcactggagactgtctggcacaaactacactgtaaacaactcctcaaacattttcatctgcatacatgacattagattctccaaatgtccaattaaacacttgtcaatggaagaaatgtttgtttcctcagctgacctgttgcagccttggcttcctgatggggaagcagnttcagctgatactggtgnatgctcttcctttctggcctgatcttgtccctgttgagaactgtggagactgggccaagctggggccatgggattagggtaggcaactaaagaaaatatccagggctgggagcacttttcaaacctaagaaaacttt

SEQ ID NO: 54153 - DNA, 406 bp, Homo sapiens
  misc_feature 215, 235, 350: n = A,T,C or G
ttcttggaaaatcagagtacagcagatgtcaatttttgaccagaggaaaggattttctgtctttatttaaccttttgtgcatataatcttatatttcttataaaaagctttataaatgacaaaaaagagaatatttgaagatgagttacaaaacaaattcttttaaacagttatttccttattaccagtctctgtaaaatttctttaataacagngtttttatatatatttaagnttttatgtattaatgtctttcatagaacttgcagaatattctcacctgatcttgctacagaattttatttgaaaatttaattaaggtggattccaaacctcctattattggatgnctaaaattattaaaaaattaattttaattatcacgaaaaaaaaaaaaaaaaaaaaa

SEQ ID NO: 54154 - DNA, 262 bp, Homo sapiens
  misc_feature 53, 76, 149, 158: n = A,T,C or G
tcaaatgaaaggtttgataattgcgtctgttactacttagtttcataggctgnaattctagtatgcattaaatatngggcaaaattgcacttgactaattttttgaagaaaagtaatttattctgtcaagaaataaaaaaataggcttngtgtatggntaaactgtaaatcttatgtttacaaaatactgtaattttcaggaaatcactgtattaggaatgtgcaatgacttatataaataaaagccatttttaaaactgag

SEQ ID NO: 54155 - DNA, 229 bp, Homo sapiens
  misc_feature 33, 51, 61, 150: n = A,T,C or G
gatacaatgcgtagatagaagaagccccacggnagccaggatgggactggncgtgttatgngcttttctccaagtcagcacccaaaggtcaatgcacagagaccccgggtgggtgagcgctggcttctcaaacggccgaagttgcctctnttaggaatctctttggaattgggagcacgatgactctgagtttgagctattaaagacttcttacacattggagaaaaaa

SEQ ID NO: 54156 - DNA, 191 bp, Homo sapiens
  misc_feature 76, 117, 126, 149, 153: n = A,T,C or G
gaggccaagaatattgcaaaatacatgaagcttcatgcactttaagaagtatttttagaataagaatttgcatacntacctagtgaaacttttctagaattatttttcactctaagncatgtatgnttctctttgattatttgcatgtnatgnttaataagctactagcaaaataaaacatagcaaatggg

SEQ ID NO: 54157 - DNA, 334 bp, Homo sapiens
aacataagaagtattctgaagatagcgacagtgactctgattctgaaacagactccagtgatgaagataacaaaaggagagcaaagaaagccaagaaaaaggaaaagaagaagaaacacagatcgaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctgg

SEQ ID NO: 54158 - DNA, 255 bp, Homo sapiens
  misc_feature 32, 54, 125, 133: n = A,T,C or G
gttttaagttacagaaaatctatgagaccttnatgtcacactgaaaagtcttgnggttatttcatgatctgcaatgactatttaaataacatggctgcagtgaatatgacagtaaaattataaanggcatttnggctctttgaggatatgagcttgcagactacagcatctgcccttgtttttgtcccatcctgtggcagaggacattgaaatggcaagaaccctgcagttactgggaactacttcagacttttg

SEQ ID NO: 54159 - DNA, 376 bp, Homo sapiens
  misc_feature 20, 333: n = A,T,C or G
gtattttaaatgaagtgatnctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagntgataagaggaatttggataattatggggggggattattttta

SEQ ID NO: 54160 - DNA, 452 bp, Homo sapiens
  misc_feature 57, 63, 413: n = A,T,C or G
cagccagcgcaggggcttctgctgagggggcaggcggattttgaggaaaccgcaganaagttnttttctctggggaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgggagtaaaaaatgtatttaaaagaaaattgagagaaaggactacagagccccgaattaataccaatagaagggcaatgcttttagattaaaatgaaggtgacttaaacagcttaaagttaagttaaaagtggagggtgantaaaataatttgaggcgatcttttaaaaagagattaaac

SEQ ID NO: 54161 - DNA, 148 bp, Homo sapiens
  misc_feature 21, 41, 95, 114: n = A,T,C or G
gggctgtaccagaaacatttncttttattgatacttgcttnttaaactttgtttagccacttaaaatctgcttatggcacaatttgcctcaaaanccattccaagttgtatatntgttttccaataaaaaaattacaatttacccaaa

SEQ ID NO: 54162 - DNA, 387 bp, Homo sapiens
  misc_feature 230: n = A,T,C or G
cgtaaccttgtggagaagaccccgcgctggtgagcgctgctgtgacttactcgaagcctcgattggcacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtgccactgaggngttgatgtggtttatgtcggagagattataggcaagcggggcatcattggctatgatgtttgaagaccaatctttaacatctgattatatttgatttattatttgagtggtggtggccatgtgtgatcagactgctatctgaataaaataagaattg

SEQ ID NO: 54163 - DNA, 233 bp, Homo sapiens
  misc_feature 36, 150, 151, 152: n = A,T,C or G
ggactacagagccccgaattaataccaatagaaggncaatgcttttagattaaaatgaaggtgacttaaacagcttaaagtttagtttaaaagttgtaggtgattaaaataatttgaaggcgatcttttaaaaagagattaaaccgaagnnnattaaaagaccttgaaatccatgacgcagggagaattgcgtcatttaaagcctagttaacgcatttactaaacgcagacga

SEQ ID NO: 54164 - DNA, 310 bp, Homo sapiens
agttaagaaaaaacaacttctcaggtactggaaactttggttttgggatccaggaacacatcgatctgtgtatcaaatatgacccaagcattggtatctacggctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtcaa

SEQ ID NO: 54165 - DNA, 246 bp, Homo sapiens
  misc_feature 33, 45: n = A,T,C or G
ggaaactgcattgtaaaaagagaagaaaatggnaggttttccagntccacagaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacactgttc

SEQ ID NO: 54166 - DNA, 417 bp, Homo sapiens
  misc_feature 35, 127, 136, 370: n = A,T,C or G
gttttttggggaaaccgcggataagatgttttctntttgaaagatagagattaatacaactacttaaaaaatatagtcaatagggttactaagatattgcttagccgttaagtttttaacgtaattntaatagctnaagattttaagagaaaatatgaagacttagaagagtagcatgaggaaggaaaagataaaaggttctaaaacatgacggaggtgagatgaagcttcttcatggagtaaaaaatgtatttaaaagaaaattgagagaaaggactacagagccccgaattaataccaatagaagggcaatgcttttagattaaaatgaaggtgacttaaacagcttaaaggttaggttaaaaggtgnaggtgattaaaataatttgaagggcgatcttttaaaaagagattaac

SEQ ID NO: 54167 - DNA, 391 bp, Homo sapiens
aatgatataaattggtgtattgctcccccaccttttattttgagaaaatttaaaccgttttttagatacaaaaaatatgattgtcatgtagaatgatattattaacatcttaaaaatcacctgtgccgggcaccggtggctcacgcctgtaatcccggcactttaggaggctgaggtgggaggatcacctgaggtcaggagttcaagactagcctgccaacatggtgaaaccccatctctaataaaaatacaaaaattagccgggcgtgatggcacgtgcctgtagtcacagctactcaggaggctgaggcaggagaaccacttgaacttgggaggtggaggttgcagtgaagccgagatcacaccactgcactccagcctggcaatagag

SEQ ID NO: 54168 - DNA, 374 bp, Homo sapiens
  misc_feature 328, 346: n = A,T,C or G
aactctttggcagtttcttataaagttctgtccttttaagccaggaattccacttctatgtatttattttaaaaagaaaacatgtccacacacacacacacacgcacacacagacacacaaaacttgtaagagaatattcatagcaacataattcataattgtcaataactagaaatagtccagatgttcatcaacagaagaataaacaaattgagtgcatgttacacaaggggttactactcagcagaaaaaaaatatgaactactgatacatgcaataaaacagatgcgcctaaaacattgttaagcaaaagatgccagacacagnggagacatgtagtatgancaatttatgtgaatttcaagtaaaatca

SEQ ID NO: 54169 - DNA, 152 bp, Homo sapiens
aaaatctgcatatttgtatttcaacaatgtagctaaaacttgaggtaaattcctccttttgttccttttttggcttaatgaatatcatttattcagtatgaaatctttatactatatgttccacgtgttaagaataaatgtacattaaatct

SEQ ID NO: 54170 - DNA, 409 bp, Homo sapiens
  misc_feature 23: n = A,T,C or G
actaccaacactggagaggagcncctggatcttatcaggctcagctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtgcctctctaaaagtacaaaacattcataagagaaacctgcatacattttgatattaagaaataattccggggattcttccact

SEQ ID NO: 54171 - DNA, 448 bp, Homo sapiens
  misc_feature 39: n = A,T,C or G
tgtgggaagagtactcaggtttcaatgaaaacctcaccntaaaaaatcaggaatgaaggccaccattgaccctgtacgtggattacttttgtatttgaccacgtaagacaattggatgggcacctaatatatttcctggtacactcctattgtggttggtcttctttatctgtatgtctatcttgttcagtctgcgcttcagctttgcaggaaaatagaaatttttttttctgtgcttgtttatgctaaccatggtgcctacaactgcatctactgctttacacgggactgcaaacctgtttttttcaaccttctgttttatgggtgtgcacacccataaatctcctgtggctggggtaagggacatacaagcagctcttcagcattaagaatgtgatgggagagatcaggtagatttgaactgccatcatcaatcaagaccaaggag

SEQ ID NO: 54172 - DNA, 327 bp, Homo sapiens
  misc_feature 136, 206, 216: n = A,T,C or G
taccggaaaacacccgtggggccggaggcggcaattcaccgaattcgaatcaccctaacaagccgcaacagtaaaatccttggaaaaggtgtgtgctggacttgataagaggcgcaaaagaaaagaatctcaaagngaaaggaccagttcgaatgcctaccaagactttgagaatcactacaagaaaaactccttgtggtgaaggntctaagacgngggatcggtttccagatgagaattcacaagcgactcattgacttgcacagtccttctgagattgtaagcagattacttccatcagtattgagccaggagttgaggtggaag

SEQ ID NO: 54173 - DNA, 366 bp, Homo sapiens
  misc_feature 294, 316: n = A,T,C or G
gacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagnaagcattattatttggaggagntgatgagaaaggaccccagctgtttcatatggacccatctgggacctttg

SEQ ID NO: 54174 - DNA, 455 bp, Homo sapiens
  misc_feature 46: n = A,T,C or G
ccaagcatggaatcttatgaacttaatcccttcattaacaggaganatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattgctgaaatacataggcttatatacaatgcttctttcctgtatattctcttgctggctgcacccctttttcccgccccagattgataagtaatgaaagtgcactgcagtgagggcaaaggagagcaacatatgtgattg

SEQ ID NO: 54175 - DNA, 459 bp, Homo sapiens
  misc_feature 77, 436: n = A,T,C or G
gaaggaccaaaaaggaacttgcatcagcacttgaagtcagccttatctggccacctggagacggtgattttgggccnattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaaggggatcaagcatcatgaccgagcggagnggggccccaccttcagaaagtat

SEQ ID NO: 54176 - DNA, 213 bp, Homo sapiens
  misc_feature 19, 78: n = A,T,C or G
cacaaagtgtcatgtatangcacttaactccaacatcagaacacatctcgtcctaagtgtttcagataagagatactnatcctgtgtatagtaggttggacttctgtttctctctaccacaagatacaggtaatttggggcagtaaaagatcctggatagatttaaaaatactacaaagctgtacatgaaacaggattacttttttttttttt

SEQ ID NO: 54177 - DNA, 449 bp, Homo sapiens
  misc_feature 38, 404: n = A,T,C or G
cagcgcagggcttctgctggagggggcaggcggttttntgaggaaaccgcagacaagatgttttctctttgaaagatagagattaatacaactacttaaaaaatatagtcaatagggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaagggtgacttaaacagcttaaaggttagtttaaaagttgnaggggattaaaataatttgaaggcggatcttttaaaaagagatta

SEQ ID NO: 54178 - DNA, 452 bp, Homo sapiens
aaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggttgggatcaataggaaagcatatgcagccaaccaagatgcaaatgttttgaaatgatatgaccaaaattttaagtagggaaagcacccaaacactt

SEQ ID NO: 54179 - DNA, 450 bp, Homo sapiens
  misc_feature 155, 156, 271: n = A,T,C or G
aaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttnnaatgtgatcccttcatttgaatattaatggctttttccattaaagaataaaatattttggacaatgccgataaatgtatgaagttagtatccacatcataaattcagagtgatgnttagcagtaaatcaatattttgaagtgatacacagatgctttcctccccacaaacttttttaaacaaaaaacaagacctcttttctttagatggggccacctatgcccaccacaacagagattttacatggaaaccggctcagtgagaactgatttcctgcccaatatttgtcttgggg

SEQ ID NO: 54180 - DNA, 170 bp, Homo sapiens
  misc_feature 121: n = A,T,C or G
gtcattattggctcaactttcctcactatctgcttcatccgccaactaatatttcactttacatccaaacatcactttggcttcgaagccgccgctgatactggcattttgtagatgtggnttgactatttctgtatgtctccatctattgatgagggtcttaaaaaaaa

SEQ ID NO: 54181 - DNA, 357 bp, Homo sapiens
ttctgcccacttatgcagggattcttaatttgttctactataaaataatgtgagtgttctctctagccataagtacctcaatggtttgaaatgcagaaagtgtaattaaatttgaagctgaaaaggaaggcaccttggagagtcctggctcttattagctttcaagctagggacaaacagatgccacagaccatttgagggctgtttgttggatgatgctaattgtttactgtgcttattattctgtgacatccttagaatcacccaggtggggagatgtcagactaaagttaccaatatctgtgctaagaaaaactcaacacttctatagtttaagtccattttggaaaaaaaaaa

SEQ ID NO: 54182 - DNA, 409 bp, Homo sapiens
tcctgctgtgcagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggaccccaatctga

SEQ ID NO: 54183 - DNA, 238 bp, Homo sapiens
  misc_feature 36: n = A,T,C or G
taagcacaaggagaaagaaggttaggctggctcgtnctgaaatgttataaggcggatgagaacggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaaaaaaaaa

SEQ ID NO: 54184 - DNA, 241 bp, Homo sapiens
  misc_feature 70, 72, 73, 101: n = A,T,C or G
aaggactccattcggctggttaaaagatgcactaaacctgatagaaaagaattccagaagattgccatgncnnagcaataggatttgctataatgggattnattggcttctttgtgaaattgatccatattcctattaataacatcattgttggaggctgaatacattttggaagagagtttttcatcttagagattggtgaacaagcgcgagggtgtgagaaactcacagaatacaaatt

SEQ ID NO: 54185 - DNA, 345 bp, Homo sapiens
  misc_feature 260, 288: n = A,T,C or G
agaaaatggaaaggccaagatccaggataaggaaggaattcctcctgatcagcagagactgatctttgctggcaagcagctggaagatgagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagncccttctgatgaatgtggtgctgggggnttatggcaagcactttgacagacattattgtggcaaatgttgtctgacttactgttt

SEQ ID NO: 54186 - DNA, 430 bp, Homo sapiens
  misc_feature 25, 44: n = A,T,C or G
ttatttgctttgtgattaaaagaanatatttatagactgaactnaactgtgtcttgatataataaaaacttaatgggcattcatttgatttgcatatgtacatgtataattatcaagaaatcttctggaaagttgtaaaatgtagaaagggaaaattaatccttatgttcatttcttgtaagatctaatctattatctaatgaatgatctgtttttaaagacctaaagcattatttgaaatacctatcgttgttaatatatgtgttgataaagctgctcatttagacatctaccattaactaacattttgtatcctttaaggtatctctctgaattcctttacgcatgggttgatgcaacattgagtcgtgccgatggctctcaaatggcagaggaaaggataatggaagacagcagaaagccgtagtag

SEQ ID NO: 54187 - DNA, 454 bp, Homo sapiens
  misc_feature 43, 44: n = A,T,C or G
aagattaaaaagttcctcacggagtcccatgaccgacaggccnnaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacggtccgtggtctccgcaatgatgtcagcgacgtcattaaaagggaaagcaccctgaacatggtggccgcaggggtaatgaagatatcatgatcacagtgattcccgaagaaattgacccataggcagaggcatgagctggacttcatgtttccctcaaagactctcccgtggatgacggatgaggactctggctgctggaataggacact

SEQ ID NO: 54188 - DNA, 141 bp, Homo sapiens
  misc_feature 123: n = A,T,C or G
cctccttcatcctgtaaaggtcaacttttaaaaccaaattatggggctgcttttgcacactggcatagagaatgtgttgaaatttaactttgtaagcttgtatgtggttggtgatcttttttntccttacagacacccata

SEQ ID NO: 54189 - DNA, 217 bp, Homo sapiens
gggatatagagcacattatctaaaccattttgtagttccaaaaacccatctaaatttcttgaggtcctgaattttgaacaggattacctggagcctggagccactttaagttgtacttctgactaaactggaattatgagtgaggaagagtgtttactaaataaatgactggggcaagcaaaattgaggaggaaattagaaactgttgaaaaaaaaa

SEQ ID NO: 54190 - DNA, 401 bp, Homo sapiens
  misc_feature 283, 313: n = A,T,C or G
gaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgtcccccaaaaatttgaatttttttttcaacactcttacacctgttatggaaaatgtcaacctttgtaagaaaaccaaaataaaaattgaaaaataaaaaccataaacatttgcaccacttgnggcttttgaatatcttccacagagggaagnttaaaacccaaacttccaaaggtttaaactacctcaaaacactttcccatgagtgtgatccacattggtaggggctggcctagacaga

SEQ ID NO: 54191 - DNA, 454 bp, Homo sapiens
  misc_feature 386, 446: n = A,T,C or G
caatgacgccctgcgccaggcaaagcaggagtccactgagtaccgggagacaggtgcagtccctcacctgtgaagtggatgcccttaaaggaaccaatgagtccctggaacgccagatgcgtgaaatggaagagaactttgccgttgaagctgctaactaccaagacactattggccgctgcaggatgagattcagaatatgaaggaggaaatggctcgtcaccttcgtgaataccaagacctgctcaatgttaagatggccttgacattgagattgccacctacaggaagctgctggaaggcgaggagagcaggatttctctgcctcttccaaacttttcctccctgaacctgagggaaactaatctggattcactccctctggntgatacccactcaaaaaggacacttctgaataagacggttgaaactagagatggacaggntatcaacg

SEQ ID NO: 54192 - DNA, 305 bp, Homo sapiens
  misc_feature 257: n = A,T,C or G
acaaaactgctgtgtgcatatgttaaagcttatttttatgtggcttatgattttattacagaaatgtttttaacactataccctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattntagtcctgaacgctacggggaaaatgcattttcttcagaattatccat

SEQ ID NO: 54193 - DNA, 441 bp, Homo sapiens
  misc_feature 41, 73, 399, 416: n = A,T,C or G
gagagtaaatcatctttccaatccagaggaacaagcacgtntctctgccaagatccatctaaactggagtganggtagcagacccagcttagagttcttctttctttcttaagccctttgctctggaggaagttctccagcttcagctcaactcacagcttctccaagcatcatcctgggagtttcctgagggttttctcataaatgagggctgcacattgcctgttctgcttcgaagtattcaataccgctcagtattttaaatgaagtgatactaagatttggtttgggatcaataggaaagcatatgcagccaaccaagatgcaaatgttttgaaatgatatgaccaaaattttaagtaggaaagtcacccaaacacttctgctttcacttaaggnctgggccgcaatactgnaggaacaagcatgatcttgttactg

SEQ ID NO: 54194 - DNA, 346 bp, Homo sapiens
gacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgttt

SEQ ID NO: 54195 - DNA, 356 bp, Homo sapiens
  misc_feature 328: n = A,T,C or G
acagaatacatacttattcccatttttaagcatttgcttctgttttccctacctagaatgtcagatgtttttcagttatctccccacttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagnacatttgaattggatatataataaatat

SEQ ID NO: 54196 - DNA, 257 bp, Homo sapiens
  misc_feature 43: n = A,T,C or G
acataatcttagtccaactaatgcagtcgatacaatgcgtagntagaagaagccccacgggagccaggatgggactggtcgtgtttgtgcttttctccaagtcagcacccaaaggtcaatgcacagagaccccgggtgggtgagccgctggcttctcaaacggccgaagttgcctcttttaggaatctctttggaattgggagcacgatgactctgagtttgagctattaaagtacttcttacacattgaaaaaaaa

SEQ ID NO: 54197 - DNA, 176 bp, Homo sapiens
  misc_feature 74, 92: n = A,T,C or G
cagttatttatttccaaaatgtgttggaaacagtataatttgacaaagaaaaatgatacttctctttttttgcngttccaccaaatacaatncaaatgctttttgttttatttttttaccaattccaatttcaaaatgtctcaatggtgctataataaataaacttcaacactctt

SEQ ID NO: 54198 - DNA, 182 bp, Homo sapiens
tgcagattatttgcccaaatcttcttcagattcagcatttgttctttgccagtctcattttcatcttcttccatggctccacagaagcttcgtttcttgggcaagcagaaaaattaaatggtacctatttcgtatatgtgagatgtttaaataaattgtgaaaaaaatgaaataaagcatgt

SEQ ID NO: 54199 - DNA, 427 bp, Homo sapiens
gaggaagatgaagtttttgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagtctgcaatgtaaatagaacactaattaaaaaacaacttgtaaaaatgcaatttaaattttaatacagacatttttcttctaatatgatggagacattctgaatcttagactttctgagggggtta

SEQ ID NO: 54200 - DNA, 379 bp, Homo sapiens
  misc_feature 36, 63, 82, 121: n = A,T,C or G
attaggagatctgcacatcccacaccggtgcaacantgttgcagctaaattcaaaaaactgcngggccaggaaaaattcagnacattctctgcacaggaaacctttgcaccaaagagagtnatgactatctcaagactctggctggggatgtcatattgtgagaggagacttcgatgagaatctgaattatccagaacagaaagttgtgactgttggcagttcaaaattggctgatccatggacatcaaggtattccatggggagatatggccagcttagccctgttgcagagcaatttgatgtgacattcttatctcgggacacacacacaaattgaagcatttgagcatgaaaataaatctacattaatccaggtct

SEQ ID NO: 54201 - DNA, 296 bp, Homo sapiens
aaatgacccttaatgaagagagagccaaaataacaagtcattgatacttttaagatgaagtggtttcatttctgtcaggttagatgatttgcaaggttatgatgaaaattggaatggaagaaaaacaataagaagaatatttttaaaagtcaaataagataaaataagttgcttgtcacaagaaagtgatttcagtttcccttataaagacaaagttatcagaatgtataaaaagcatttccagggagtgttatttataatagatgcttctaaacaaattgagaggaagcttcccg

SEQ ID NO: 54202 - DNA, 443 bp, Homo sapiens
aaactctgaagaaattgttacaagaagacactcccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgcattaaaagtctggctaactttggaatccattagagaaaaatccttgcaccagattcattacaattcaaatcgaagagttgtgaactgta

SEQ ID NO: 54203 - DNA, 454 bp, Homo sapiens
  misc_feature 39: n = A,T,C or G
tctcctgcagcgtctggggtttccgttgcagtcctcgtnccaggacctcggcgtggcctagcgagttatggcgacgaaggccgtgtgccgtgcttgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggcttgtaccagtgcaggtcctcactttaatcctctatccagaaaacacggtgggccaaagggatgaagagagcatgttggagacttggggcaatgtgactgctgacaaagatggtgtggccgatgtgtctattgaagattctgtgatctcactctcaaggagaccattgcatcattgggccgacacttgtggtccatgaaaaagcagatgacttgg

SEQ ID NO: 54204 - DNA, 408 bp, Homo sapiens
  misc_feature 19: n = A,T,C or G
gtcgcgcctacctggacangacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagagcctatttctggaattgcagaagataacatatttcccttattttgatttaatcaccataaaccatacctatttaatgagtgtattctgtgcaatttttttctcagattgctttaactttgtttttaaaatgaccttcaaaataaac

SEQ ID NO: 54205 - DNA, 148 bp, Homo sapiens
atagtggaagggccttcaattgtatcagtacttttttttaagctctggcacattgacctctatgtgttaccagtcattaatgagctgctgcagaggtgactatttgttttactttcttggatgttaacattacactactcactactca

SEQ ID NO: 54206 - DNA, 399 bp, Homo sapiens
  misc_feature 11: n = A,T,C or G
tgctccgcaancatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgccctttcacatcaaagaactactgacaacgaaggccgcgccttgctttcccatctgctatctatctggctggcagggaaggaaagaacttgcatgttggtgaaggaagaagtggggtggaagaagtggg

SEQ ID NO: 54207 - DNA, 263 bp, Homo sapiens
gcaagctgtgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagtattttatgattgcaac

SEQ ID NO: 54208 - DNA, 320 bp, Homo sapiens
  misc_feature 126, 221, 247: n = A,T,C or G
cgtgatcaagaatttggtgtggacgttggcctgtttgctttttataaaccaaactctatctgaaatcccaacaaaaaaaaatttaactccatatgtgttcctcttgttctaatcttgtcaaccagngcaagtgaccgacaaaattccagttatttatttccaaaatgtttggaaacagtataatttgacaaagaaaaatgatacttctctttttttgctgntccaccaaatacaattcaaatgcttnttgttttatttttttaccaattccaatttcaaaatgtctcaatgggctataataaataaacttcaacactcaa

SEQ ID NO: 54209 - DNA, 290 bp, Homo sapiens
  misc_feature 63, 122, 150, 190, 245: n = A,T,C or G
gcccctttataaatccaaggagataggaagaaagaagacaaactttgcatctcaagtatgaantattcaatttatttgaatgatttttctttacaaaacaaactcattcattaggcatgttnatctgcttaggagtttagggaacaattnggcaattttgtgggtttcgagattatcgttttcttaaagngccagtattttaaaatagcgtcttgtaattttacacgcttttgggatggagtgcngttttgttatataatttagacttggattctttccatttgcatttg

SEQ ID NO: 54210 - DNA, 185 bp, Homo sapiens
atttcagtgctattataatttggtaagtgtagttagaaaaatcatttcttccaccttttgagttaaagaaaatcttttttgaagttgacatctgatgtcaagtatttccatttattttgcttagcaacctctgagcctctgaatttccaatattcttctttgtctcccattcctaatattcctca

SEQ ID NO: 54211 - DNA, 400 bp, Homo sapiens
aacaagatgcacaaaagaggcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgcgaccccatatatgattttctttaaggatggtttagaaatggaaaaatgttaacaaatgtggcaattattttggatctatcacctgtcatcataactggcttctgcttgcatccacacaacaccaggacttaaggacaaatgggactgatgtcatcttgagctcttcatttat

SEQ ID NO: 54212 - DNA, 160 bp, Homo sapiens
ctgggggaattttcatttgcatctatgtttttagctatctgtgataacttgttaaatattaaaaagatattttgcttctattggaacatttgtatactcgcaactatatttctgtaaacagctgcagtcaaaaataaaacactgaaagtttccaaaaaaa

SEQ ID NO: 54213 - DNA, 164 bp, Homo sapiens
  misc_feature 30, 78: n = A,T,C or G
gggggaaccatgagtgctaaatgtgttcgngacaggatcaagcgtgctttccttatcgaggagcagaaaatccggtgngaaagtgttgaaggcacaagcacagagtcagaaagctaaataaaaaaatgaaacttttttgagtaataaaaatgaaaagacgctcc

SEQ ID NO: 54214 - DNA, 387 bp, Homo sapiens
  misc_feature 57, 114: n = A,T,C or G
cagcttcagctcaactcacagcttctccaagcatcaccctgggagtttcctgagggntttctcataaatgagggctgcacattgcctgttctgcttcgaagtattcaataccgntcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtggcttggcccgcaatactgtagggacaagcatgatcttggtactgtgatattttaaatatccacagtactcactttttccaaatgatcctagtaattgcctagaaatatcttttctcttacctgta

SEQ ID NO: 54215 - DNA, 360 bp, Homo sapiens
attgtagatattgcaccctatgacattggtggtcctgatcaagaatttagtgtggacgttggccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtataatttgcaaagaaaaatgatacttctctttttttgctgttccaccaaatacaattcaaaatgctttttgttttatttttttaccaattccaatttcaaaatgtctcaatggtgctataataaataaacttcaacactctttatgaca

SEQ ID NO: 54216 - DNA, 109 bp, Homo sapiens
  misc_feature 13, 30, 31: n = A,T,C or G
gaagaccagatgnagctacaggatgatganncatggtttcaaacgagttctttcttgttactttttaaaatttcttttttataaattaatattttattgttggatcctc

SEQ ID NO: 54217 - DNA, 402 bp, Homo sapiens
ccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttggtgccactttgggtattctgagattttctcttgcatgcccttagctttacagctttgcatttcctggtggattattctcaagcattt

SEQ ID NO: 54218 - DNA, 289 bp, Homo sapiens
  misc_feature 18, 38, 52: n = A,T,C or G
cacgtaggagttttgttntaccgtattccaaagcgtgngctggttctcatancgtctgtagggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaacc

SEQ ID NO: 54219 - DNA, 210 bp, Homo sapiens
  misc_feature 23, 47, 156: n = A,T,C or G
tcatcatctgctttccacatatnaaaatcaccttggttatctatagntcaatcttctaaagccttcaagcctctgaaattcttcaaaattcagaagaagtagaaggaagtttttgatgatgagtgaggtggaggtgagtgctttgcagaaactgtnggaaatgtaccaaagtaaatgaacattaacgggaaatagccaaagaataaacct

SEQ ID NO: 54220 - DNA, 307 bp, Homo sapiens
  misc_feature 53, 57, 58, 75, 76, 107: n = A,T,C or G
aggccagtggaaatgtaaagaaggccctgaagctgatggggccaaatgaaggngaanncaaggctgaaggaaatnncaaattcacctacacagttctggaggatggntgcaccgaaacacactggggaatggagcaaaacagtctttgaatatcgaacacgcaaggctgtgagactacctattgtagatattgcaccctatgacattggtggcctgatcaagaatttggtgtggacgttggccctgtttgctttttataaaccaaactctatctgaaatcccaacaaaaaaaatttaactccatatg

SEQ ID NO: 54221 - DNA, 100 bp, Homo sapiens
  misc_feature 79, 91: n = A,T,C or G
gggaggaaaaagccatgatggacataaatgtacacaaatacatgtaacactaaatacaaatatgtgtaacactaaatgnacacaaatatgnggaatggta

SEQ ID NO: 54222 - DNA, 118 bp, Homo sapiens
  misc_feature 8, 88: n = A,T,C or G
accatctnccactttaagctaagttatgatacctattccattcacaattggggtctttttaagggttgcaaatttcagccaattttgnagctaagattgtctgatcagctcaaaaaga

SEQ ID NO: 54223 - DNA, 358 bp, Homo sapiens
  misc_feature 12, 75, 194, 264: n = A,T,C or G
acagaagtactntgtgcgatccatgcccatccgaaaggatgatgaagccaggttgtacgtggacactataaaggncagcaaattggcaaagtagtccaggtttacaggaagaaatatgttatctacattgaacgggtgcagcgggaaaaggctaatggcacaactgtccacgtaggcattcaccccagcaaggnggtatcactaggctaaaactggacaaagaccgcaaaaagatcctcgaacggaaagccaaatctcgcaagnaggaaaggaaaagggcaaatacaaggaagaaaccattgagaagatgcaggaataaagtaatcttatatacaagcttggattaaaacttgaaaca

SEQ ID NO: 54224 - DNA, 250 bp, Homo sapiens
  misc_feature 16, 21, 23, 95, 111, 119, 166, 185, 187, 213: n = A,T,C or G
gcagctttggataagnttcgngnggctgatcaaagaaagaaggcatacgcagatttctacagaaactacgatgtcatgaaagattttgaggagangaggaaggctggatcnttcagagnggaaaggaatcttggaatataaagaatttcttcagggtgaattaccnagaagttgcactgacttgngntcctgaactatgacacatgaatatgngggctaagaaataggtcctcttgataaataaacaatt

SEQ ID NO: 54225 - DNA, 370 bp, Homo sapiens
  misc_feature 165, 278, 302, 327, 333, 357: n = A,T,C or G
gggctaactttgctgctaggggctcaagccacgcctgcaaatcgcctctcttgctacagaaagatactaaaagatcacaactgtcacaaccttccggaaggagtagctgacctgacacagattgatgtcaatgtccaggatcatttctgggatgggaagggatgngagatgatctgttactgcaacttcagcgaattgctctgctgccaaaagacgttttctttggaccaaagatctctttcgggattccttgcaacaatcaatgagaatcttcatgnattctggagaacaccattcctganttcccacaaactgcactacatcagnataacngcatttctaggttctatatagggnaataagagcatag

SEQ ID NO: 54226 - DNA, 163 bp, Homo sapiens
  misc_feature 56: n = A,T,C or G
ggtagagtctttagggttttctagctatagaatcatattgttggactgggtgtggnggcttacacctgtaatcccaatgttttgggaggccaaggctggaggatcacttgagcccaggagtctgagacaagcctggacaacatagtgaaaccctgtctctact

SEQ ID NO: 54227 - DNA, 361 bp, Homo sapiens
  misc_feature 20, 23, 46, 71, 117, 307, 336: n = A,T,C or G
aagcacatccttgctaattncanaaactaccagttctttattgttnaaaacatgaatccagatggcatggntgctctattggactaccgtgaggatggtgtgaccccatatatgacnttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttactttgactgtgatttatttggagtggaggcattgnttttaagaaaaacatgtcatgtaggttgnctaaaaataaaatgcatttaaactc

SEQ ID NO: 54228 - DNA, 149 bp, Homo sapiens
  misc_feature 80, 117: n = A,T,C or G
gttctttgccagctcattttcatcttcttccatggttccacagaagctttgtttcttgggcagcagaaaaattaaattgnacctattttgtatatgtgagatggttaaataaattgngaaaaaaatgaaataaagcatgtttggtttcc

SEQ ID NO: 54229 - DNA, 224 bp, Homo sapiens
  misc_feature 16, 29, 53, 98, 100, 118, 134, 147, 210: n = A,T,C or G
ctcagaactgtttggntcaattggccatntaagtttaggagtaaaagactggntaatgataacaatgcatcggaaaaccttcagagggaaaggagaangntttgtggaccactttggntttcttttttgcgggnggcaggtttaagntattaggttttaaaatcaggactttttaatggaaacaacttgccaaaaatttgcacagaattntgagacccattaaa

SEQ ID NO: 54230 - DNA, 108 bp, Homo sapiens
  misc_feature 88: n = A,T,C or G
aaaattagcttcattcaatatttatcatcctcctttccctctctgagaatggactatgtataaaataagcttctgcctatttgcattnatcttccaaacccaatctag

SEQ ID NO: 54231 - DNA, 349 bp, Homo sapiens
  misc_feature 242: n = A,T,C or G
cagaactgattcctgatataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgagccaaacttgtcttgcagatgtagaaattgttgctttgtttctctgataaaactggntttaagacaaaaaatagggatgatcgctcttagaccatgctaatgttactagagaagaagccttcttttcttctttatgggaacttgaaatgaggaaaagcaatcta

SEQ ID NO: 54232 - DNA, 100 bp, Homo sapiens
  misc_feature 31, 44: n = A,T,C or G
tgaggcaggagaatagctggaacccaggggntggaggttgcagngagccaagagcatgccgctgcactccatcttgggccacgagcgagactctgtctca

SEQ ID NO: 54233 - DNA, 221 bp, Homo sapiens
  misc_feature 20, 39, 109: n = A,T,C or G
cagctacatccgagactccnagatctgtgcaaaagcagngagagatgcactgaagacagaattcaaagcaaatgcttgagaagacttctggcagcaacgtaaaaattgngaaagtaaagaaggaataatctaccctgactaaagcttgaaatgctacatttccaaggggaagatgtgtgggcacatgttatggcagattgaaaaggatctcattccatggg

SEQ ID NO: 54234 - DNA, 134 bp, Homo sapiens
  misc_feature 14, 34, 37: n = A,T,C or G
tgtcaatcacactnttgtataaagcagcagaacnganggggaaaaatgaccgttgtatacactgaattgctttgcatggtctcatttgagataattgatgtaagaatcctgacttttttatatttggaaacatc

SEQ ID NO: 54235 - DNA, 143 bp, Homo sapiens
  misc_feature 19, 31, 36, 41, 97: n = A,T,C or G
tgaaagatgtgcatggacnatttgatgcganttctntgctncactgcttttaatacttagcaggattggtggctaagcaatttgattattgaggagnctcagagcaagggcgtctagatgcatcctaaaaaacacttcatata

SEQ ID NO: 54236 - DNA, 176 bp, Homo sapiens
  misc_feature 57, 58, 62: n = A,T,C or G
gcatattttttaacctcaaacgtttcaataaaaccatttttcagatataaagagaannactncaaattgagtaattcagaaaaactcaagatttgagttaaaaagtgggttggacttgggaacaggactttatacctcttttactgtaacaagtactcattaaaggaaattgaatg

SEQ ID NO: 54237 - DNA, 240 bp, Homo sapiens
  misc_feature 37, 52, 81: n = A,T,C or G
tccctgtcatgagacttcagcgctaatgttcacaacntactttcgaaagaanaaaatagttctcctacatgaagaaagaanatgtcaggaaataaggtcactttatgtcaaaattatttgagtactatgggacctggcgcagtggctcatgcttgtaatcccagcactttgggaggccgaggtgggcagatcacttgagatcaggaccagcctggcaagatggtgaaactccgctgtact

SEQ ID NO: 54238 - DNA, 279 bp, Homo sapiens
  misc_feature 123, 159, 162, 248, 268: n = A,T,C or G
caaataaatgaactcaatctaaattaaaaaagaaagaaatttgaaaaaactttctctttgccatttcttcttcttcttttttaactgaaagctgaatccttccatttcttctgcacatctacntgcttaaatggggggcaaaagagaaaaagaaggatngancagagcattgtgcaatacagtttcattaactccttcccccgctcccccaaaaatttgaatttttttttcaacactcttacacctgntatggaaaatggcaaccttnggaagaaaacc

SEQ ID NO: 54239 - DNA, 323 bp, Homo sapiens
  misc_feature 107, 111, 200, 252, 286: n = A,T,C or G
cactgatagtaggtatacatgttagcattttttgctttattatttctcaaactgagctagctgagaggcagtttgtcttctgttctcctaaactgcctttgttctanaacnaggaggaatgggaaaggacagctgtcttaggaaataattattgattctttttctgtttaaagagcagagtccttctagcttgctgcggntaaccttgttccttttgtaagtgcctgcaaaggaggaatgggatagcattgngtgagatggggccttgtaggcacattaaaccagnggtctctggggagatgaaaaagcctggagatggatag

SEQ ID NO: 54240 - DNA, 388 bp, Homo sapiens
  misc_feature 13, 69: n = A,T,C or G
acccccatgattnttctacctcccaccaagtccctctcacaacacatggggattatgggaactacaatncaagatgagatttgggtggggacacagccaaaatatatcaggagttcaaacaactcagtaggaaaatagtctggcaaacatatggcaaacagacatgtgaaaaggtgctcaacatcactgatcaccagagaaataaaagcaaatcaaaactgcaatgaaatatcatcttacccccattaaaatggcttacatctaaaagacaggcaaaagcaaatgctggcaaggatgtggaaaaaaggtaaccctcatacaatgcaggtgggaatgtaaattaagtacaaccactttggagaacaggttggaggtccttaaaaaaaac

SEQ ID NO: 54241 - DNA, 143 bp, Homo sapiens
  misc_feature 10, 33, 73, 78, 93, 95, 101, 127: n = A,T,C or G
ccctccttgntgatttctctcttgatcatgggncacattttcctgcttcttatatgtcatatgtaagtaattngggantgtagcttggacatngngaaggntatattataaatactttggattatgntaaatttatctgaaag

SEQ ID NO: 54242 - DNA, 344 bp, Homo sapiens
  misc_feature 22, 36, 188, 224, 239, 296, 309, 337: n = A,T,C or G
gactaatttaagtgaaataaanccattttcaagtancacaaaagcagagacttcatcattagcaaacctttgctaattcttcagggagatgaaagacaaaaatctcaggtggaagatagagatgcggaaaggagtaaacggccacaaaatataataaagggagccagtagctaaagagggtataaaantataaatcatctagagggtgttttagctagaattgntttatacattttggngattattaggatttatgttcccaatatacttcatgtaggcaaatactagaattatgngacttcttggcgnttactgatttgggagtggggaagtgagngactgga

SEQ ID NO: 54243 - DNA, 127 bp, Homo sapiens
  misc_feature 16, 17, 35, 40, 90: n = A,T,C or G
ggacagtaaactaganntttcctttatattttagnatttncagcactccataaaccctattacctaaatattgccacactattttgtganttaaaaattcttactaaggaataaaaactttaatacg

SEQ ID NO: 54244 - DNA, 283 bp, Homo sapiens
  misc_feature 4, 109, 112, 115, 132, 146, 148, 150, 166, 194, 218: n = A,T,C or G
aganggctgccccaaaaagacaaatgaatggggaaagacaatcattgaatacaaaacaaataagccatcacgcctgcccttccttgatattgcacctttggacatcggnggngcngaccaggaattctttgnggacattggccagncngnttcaaataaatgaacncaatctaaattaaaaaagaaagaaattngaaaaaactttctctttgccattncttcttcttcttttttaactgaaagctgaatccttccatttcttctgcacatctacttgcttaaa

SEQ ID NO: 54245 - DNA, 193 bp, Homo sapiens
  misc_feature 82, 85, 133: n = A,T,C or G
ggtatttgccacaagctgggggaggagaaaatgagctgttcaatgggtattgagtgtcgggccacgcaagatggaaaagctnttngagatttgttgtataaaaatatgcctatagttaacaatactcttcggnacacacaaagtatgtgaaagggtaaattttatgtgtttttatcacaataaaaattgtaat

SEQ ID NO: 54246 - DNA, 252 bp, Homo sapiens
  misc_feature 12, 63, 89, 104, 190, 218, 249: n = A,T,C or G
accttcagaagncgacctgtggcaaatgtggctaccctgccaagcgcaagagaaagtataacnggagtgccaaggctaaaagacgaaanaccaccggaactggncgaatgaggcacctaaaaattgtataccgcagattcaggcatggattccgggaaggaacaacacctaaacccaagagggcagctgntgcagcatccagttcatcttaagaatgncaacgattagtcatgcaataaatgttctggnttt

SEQ ID NO: 54247 - DNA, 252 bp, Homo sapiens
  misc_feature 24, 37, 44, 47, 60: n = A,T,C or G
cggccgacaaaaaaatttgatttntcattcatatttnccatctnatncccaattaaaagnatgcagattatttgcccaaatcttcttcagattcagcatttgttctttgccagtctcattttcatcttcttccatggtccacagaagctttgtttcttgggcaagcagaaaaattaaattgtacctattttgtatatgtgagatgtttaaataaattgtgaaaaaaatgaaataaagcatgtttggttttcc

SEQ ID NO: 54248 - DNA, 100 bp, Homo sapiens
  misc_feature 17, 33, 95: n = A,T,C or G
ggagagagagtatgttnatttaacacccatagnaggcctaaacgcagccaccaattaagaaagcgttcaagctcaacacccactacctaaaaaancccaa

SEQ ID NO: 54249 - DNA, 308 bp, Homo sapiens
  misc_feature 303: n = A,T,C or G
agctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagntaaat

SEQ ID NO: 54250 - DNA, 179 bp, Homo sapiens
  misc_feature 25, 37: n = A,T,C or G
ccacagcttcccccatagaaggatntcatgagcagancaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 54251 - DNA, 445 bp, Homo sapiens
  misc_feature 4, 42, 326, 381, 423: n = A,T,C or G
gctnctgtaggatatctaacgtctaaatctacagaaagactngataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggnttgtaaaatcttgaatggttgctcttctaggaattcagtatttttatggaattgnacaaaatagcttacccctactaaggttggaaaagaaaatggnagcattatcatgtcttctatct

SEQ ID NO: 54252 - DNA, 187 bp, Homo sapiens
  misc_feature 19, 30, 39, 43: n = A,T,C or G
aaaaatagttaaaaattantttgacatggnggcacgcgnctgnggcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatct

SEQ ID NO: 54253 - DNA, 164 bp, Homo sapiens
tgatgtactcgtattaactttatccaacgcagatgaatataagtccagaactatggaagtgagggtataccatgcaaacccacccagcacaccactgggcatgagccatgccctgaggaccactatagaaaaataactctcttatttctcccagcataatttgc

SEQ ID NO: 54254 - DNA, 217 bp, Homo sapiens
  misc_feature 49, 57: n = A,T,C or G
tcacgtcatccagcagagaatggaaagcaaatttcctgaattgctatgngctggggnttcatccatccgacattgaagttgacttactgaagaatggagagagaattgaaaaagtggagcattcagacttgctttcagcaaggactggctttctatctcttggactacactgaattcacccccactgaaaaagatgagtatgcctgcgggtgaccat

SEQ ID NO: 54255 - DNA, 257 bp, Homo sapiens
  misc_feature 162, 220, 236: n = A,T,C or G
ctcttcaggaaatataaggggtttgtttggctaacgtgatacattctgtatgaatgaaacattggagggaaacatctactgaatttctgtaatttaaaatattttgctgctagttaactatgaacagatagaagaatcttacagatgctgctataaataagnagaaaatataaatttcatcactaaaatatgctattttaaaatctatttcctatattgnatttctaatcagatgnattactcttattatttctatt

SEQ ID NO: 54256 - DNA, 100 bp, Homo sapiens
  misc_feature 11: n = A,T,C or G
ataattatggngggtgattattttttatactgtatgtgccaaagctttactactgtggaaagacaactgttttaataaaagatttacattccaaaaaaaa

SEQ ID NO: 54257 - DNA, 355 bp, Homo sapiens
  misc_feature 13, 233, 255, 316: n = A,T,C or G
catggctgacttncccgatatggctgagatcgagaaattcgataagccgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggntggatcaagtttaaatgactgngctgccctttcacatcaaagaactactgacaacgaaggccgcgcctgcctttcccatctgnctatctatctggctggcagggaaggaaagaacttgcatg

SEQ ID NO: 54258 - DNA, 208 bp, Homo sapiens
  misc_feature 11, 14, 15, 35, 36: n = A,T,C or G
ccctctaaatnttnncgatcaaaagggacaagcannaagcacgcagcaacgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaact

SEQ ID NO: 54259 - DNA, 140 bp, Homo sapiens
  misc_feature 14, 16, 25, 61: n = A,T,C or G
aaattcatgcaaananatgtcaggngccagtgctatggagttgttgaagaataagcacaanaccatttattaccacttctcagttgtaaagaggctgtaactctggttgcgaaataaaataaaatgaaatctcctagatg

SEQ ID NO: 54260 - DNA, 340 bp, Homo sapiens
  misc_feature 34, 282, 299: n = A,T,C or G
aaacgcaaagattaccttaagcaacacatgtttnactcatgccccagaaagggatgtatgtcgctgtccaagagaaggctgtggaagaacctatacaactgtgtttaatctccaaagccatatcctctccttccatgaggaaagccgccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagnttggctctcatctcagnggatatatccctcccaaaaggaaacaaggcaaggcttatct

SEQ ID NO: 54261 - DNA, 347 bp, Homo sapiens
  misc_feature 15: n = A,T,C or G
cacagaacaacttanaacacaaccacagtattttaaagaaacaataatacagagatatcgacaaaagctggggaaaatagatggagaagaggataaatacagaaacacagagacacaaacatggaaagtaaagttccagaaatgcacagactcggggactcactaacacagggcatatggaaagaggcatatgcagatttatgaacatgcagaccctggaacacagagcctcagagacacccagacagaagaatacagagggaggcagtgtaagatggcggaatagaaggctccacctatcatcccctgcttcccctcaaggacaccaattaaacaactatctacac

SEQ ID NO: 54262 - DNA, 183 bp, Homo sapiens
  misc_feature 116, 120: n = A,T,C or G
gaatagaggaccattatccttctttcttcagaaaactaagaagtaagtgtaacttttaaagtaagtatatatcagtgagagtagcttgttttacaactatttctagccagggagtngggntttcatgctcatcaaaagacaataccacattgcatcattttacaaaatatgtggcatttcatt

SEQ ID NO: 54263 - DNA, 172 bp, Homo sapiens
  misc_feature 22, 30, 33, 48, 74: n = A,T,C or G
aatcaagagaaacctcaaaggnaatggganggncggatctcacaggcngagaactcgttcacctccaagcattncatgaaaaagctgcttcttattaatcatacaaactctcaccatgatgtgaagagtttcacaaatccttcaaaataaaaagtaatgacttagaaactgc

SEQ ID NO: 54264 - DNA, 117 bp, Homo sapiens
  misc_feature 33, 38, 53, 55, 61, 69: n = A,T,C or G
cctattgtagatattgcaccctatgacattggnggccngatcaagaatttggngnggacgntggcctgnttgctttttataaaccaaactctatctgaaatcccaacaaaaaaaatt

SEQ ID NO: 54265 - DNA, 239 bp, Homo sapiens
  misc_feature 34, 41, 216: n = A,T,C or G
atgaactcatccttttttatggctacatagtatnccatggngtatatgtgccacattttcttaatccagtctatcattgacggacatttgggttggtccaagtctttgctattgtgaatagtgccacagtaaacatacgtgtgcatgtgctttatagtagcatgatttataatcctttgggtatatacccagtaatgggattgctgggcaaatggnatttctttaccctagaacttaaa

SEQ ID NO: 54266 - DNA, 203 bp, Homo sapiens
tgtacaaagaagtttcttaaaaaattaactggacgtggcccaactactcgggaagctgaggtgggaagatcacttaagcctgggagattgaggctgcagtgaaccatgattgcaccactgcactccagcctgggcaacagagcgagaccctgcctcaaaacaatagaagttaaaaaataaataaaagaaaaatgacctgattt

SEQ ID NO: 54267 - DNA, 268 bp, Homo sapiens
ataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgcaggggcgcactctgtatggcttcggcggctgaatctaagaatacgcggctcctgagaacttc

SEQ ID NO: 54268 - DNA, 243 bp, Homo sapiens
  misc_feature 20, 21, 161: n = A,T,C or G
atcgaaaccatcagcctacnnattcaaccaatagccctggcgtacgcctaaccgctaacattactgcaggccacctactcatgcacctaattggaagcgccaccctagcaatatcaaccattaaccttccctctacacttatcatcttcacaattctaatnctactgactatcctagaaatcgctgtcgccttaatccaagcctacgttttcacacttctagtaagcctctacctgcacgaca

SEQ ID NO: 54269 - DNA, 100 bp, Homo sapiens
  misc_feature 34, 67: n = A,T,C or G
gcacgaaacacactggggaatggagcaaaacagnctttgaatatcgaacacgcaaggctgggagacnacctattggagatattgcaccctatgacattgg

SEQ ID NO: 54270 - DNA, 209 bp, Homo sapiens
  misc_feature 39, 74, 169: n = A,T,C or G
cttttttgcagtgacgcacatgaaattatgaaatagctntgaaatgactttaaatagctcctttaaagccgttncttacagagccatgtatttggcatctctaaacattttgcaggcaggtatttcaacgaagaacagagagctctgactgtgccagtttgaatcaggnataaattgcatagaactaattccaaacttaactgaatcat

SEQ ID NO: 54271 - DNA, 123 bp, Homo sapiens
  misc_feature 33, 100: n = A,T,C or G
actcagataaccaaattaaaagaattagaatangacctttaatacacttaacattaaactcttctaactttcttctttctgtgataattcagaagatagntatggatcttcaatgcctctgag

SEQ ID NO: 54272 - DNA, 188 bp, Homo sapiens
  misc_feature 33, 49: n = A,T,C or G
tatatattatttttgaatcgagatgtccatagncaaatttgtaaatctnattcttttgtaatatttatttatatttatttatgacagtgaacattctgattttacatgtaaaacaagaaaagttgaagaagatatgtgaagaaaaatgtatttttcctaaatagaaataaatgatcccattttttggc

SEQ ID NO: 54273 - DNA, 274 bp, Homo sapiens
  misc_feature 143, 183, 250, 259: n = A,T,C or G
tccgtgtacatctatgtcaagcctaagaaaatgcccgataagtatttcctctgaggaaggtagagggagttaggtgagtatctcaaaggagattttagccttatctatattatattgcttttaaacagaatatatagatatgncatttgtatattcaccctccaaaacaaatgtatttatggngcaaaaagatacagaatgggctaactgaaaagtcaatgatataattcctttcacacttcagggaagngatcattgntaacactaataactt

SEQ ID NO: 54274 - DNA, 166 bp, Homo sapiens
ttttggcaatgagatgaagcagtataatttgccagaagctaaaaatgccattcttacattttcatttttttttcctaaaggaacaagataaaaaagtagaaaactcaaataaagaagaaatacaggaaaaggagacaatcattgaagaattaaacacaaaaataat

SEQ ID NO: 54275 - DNA, 235 bp, Homo sapiens
  misc_feature 32, 52, 111, 134, 159, 177, 217: n = A,T,C or G
gcatgtgaacttatttttttaaattctgcatngagataagaataattcaggncgcatctgaaattttaatgaatgtataattggcatatcatggaaaattaaccagaaggnatcaggtcttaaaagttatgccnagaaattatgtaaagctaaactacngggtagaaagtattcagnggaatattgtattaatttggtaaattctaaacttgaattncaataaaattttaaagct

SEQ ID NO: 54276 - DNA, 380 bp, Homo sapiens
atggccgggattcccgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgacttttgtcacagcccaagatagtta

SEQ ID NO: 54277 - DNA, 400 bp, Homo sapiens
  misc_feature 2, 12, 82: n = A,T,C or G
cnccaggtgagnatgcaggtgaacagcattacattaactttgcgataagtgtgcctgagttctgccttctgtcagatctgcngtggttttaagattatcataggagcgcaaaccctattgtgaactgcacatgcgatggatctaggttgcatgctcctgtgagaatctaatgactgatgatcggaggtggaagagtttcatcccgaaaccatctcctccctctcacccctcctgctatctgtggaaaaattgttttccacgaaacctgtccctggtgccaaaaggttggggaccactgaactacagtatagatcagactctactgttacaagtacagatgatgtattagttctgaatactactgggagaaagattctaaaaagcagtcacagaaaaggtg

SEQ ID NO: 54278 - DNA, 267 bp, Homo sapiens
  misc_feature 17, 22, 38, 44, 83, 260, 266: n = A,T,C or G
gtgtcccgtcacagacnttttnagagtctgaagggagncattgntgtcagattccagagctcttgcagatttagagatcatcnggccaacccaggaacccactggcaaatgcatgctctagacagaatagcaaatcaggccggggcacagtggctcccgcctgtactcatagtgctttgggaggcccaggcaggaaaattgcttgaggccaggagttcaggaccaagccctgcaatgtagcgagacctcatctctaaaangaaaang

SEQ ID NO: 54279 - DNA, 400 bp, Homo sapiens
  misc_feature 10, 18, 35, 374, 384: n = A,T,C or G
gatcaccctntaaggctnatctaattaactgtgtntggaactgctataaatacatcaacaaccgaaacgtgccggagattgctgtgtaccctgcctttgaagcacctcctcagtacggttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgcttttgttaagcatttattttcaaacactaaggagctttttgacatctggtaaacgtctttttggttttttggtaagncttttacatntaataggttttgaagc

SEQ ID NO: 54280 - DNA, 393 bp, Homo sapiens
tctaccaaacgagaattctgtatccagaataaaggtaaaataaagacattttcagatgaacaaaaattgagagaactggttacaagcagacctgcactaaggaaatattaaaaaatgttctttaggtagaaagacagtgatcccagattgaccctcagagctacaggaagaaatgaaaagcagtagtaaatgtatgggtaaatctaaatgaatattgattgtataaaacaacaataatagatggagttttgctatgttgcccaggctggactcgaactcctgggcttaagcaatcctacctcagcctcccaagtacctgggactacaggtgcatgtcactgtgcccagctaacggtaattgccttttgagtttaacgtatatgtaaaattatg

SEQ ID NO: 54281 - DNA, 393 bp, Homo sapiens
gacacacgagatctcgatcgaaggcgagatggcggacgtgctagatcttcacgaggctgggggccgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatggacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatg

SEQ ID NO: 54282 - DNA, 391 bp, Homo sapiens
  misc_feature 12, 21, 23, 26, 41, 47, 49, 337, 344: n = A,T,C or G
cattccttatgngaagacttngngtnaaaagtgaacatttngaaggntnttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgnaatttgnaggtctcaaaagacttttttttaaaaaaataaagccatcttacactc

SEQ ID NO: 54283 - DNA, 398 bp, Homo sapiens
  misc_feature 12, 42, 54, 56, 60, 62, 72, 78, 81: n = A,T,C or G
cccggggtgctngctgagatgcaaaacaaatcatggaagatngcatacctgtgngntatntnaaaaacaagntgactnttncagtttcttgaacggttaagggtggatttaaaaactagacagtttagttttggggaacagaagctctcttcgtcttaagccagattctctgattcttttagacgtcatagctccttagttctgctcctgtcgccctaacttggcatgggcaagttgaagttcatccttagactgcagcgttctgagcatggctgaagtattaaaatgtttcatattttttagagcaaaattgatggaaagcatttggctgaatctaaagacctgcagtcagattcttcaatgtggtttacccaactggagtagtgataaacacctta

SEQ ID NO: 54284 - DNA, 124 bp, Homo sapiens
  misc_feature 5, 70, 121: n = A,T,C or G
atcancagggctagatagtaagtgctcagtaatccagtctccattatctgcaataaaattttttaacttnatttttgttttataaagtaatgcttactcattgtagaaaatttggaacaantct

SEQ ID NO: 54285 - DNA, 393 bp, Homo sapiens
  misc_feature 38: n = A,T,C or G
gagcaccggttcgtttttcctttagtcaggaaggacgntggtgttgaggttagcatacgtatcaaggacagtaactaccatggctcccgaagttttgccaaaacctcggatgccgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagttgtcactgacttgtgttcctgaactatgacacatgaatatg

SEQ ID NO: 54286 - DNA, 398 bp, Homo sapiens
  misc_feature 20, 24, 27, 30, 44, 55, 64: n = A,T,C or G
gaagataaacacctgaaatnccgnatntcncatgaattagatantgcatcgttcngaggccaantaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactgatgtgtttgataattagtttagtttgtggcttcatggaaactccctgtaaactaaaagcttcagggttatgtctatgttcattctatagaagaaatgcaaactatcactgtattttaatatttgtattctctcatgaatagaaatttatgtagacgcaaacaaaatacttttacccacttaaaaagagaatat

SEQ ID NO: 54287 - DNA, 400 bp, Homo sapiens
  misc_feature 14, 22, 51, 64, 367: n = A,T,C or G
gatggcctcccgtnctgaaatngacatgaatgatatcaaagcattctatcngaagatgtatggnatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagtgntctagtaacaatacatgagaaagatgctatgta

SEQ ID NO: 54288 - DNA, 258 bp, Homo sapiens
  misc_feature 6, 21, 56, 230, 254, 257: n = A,T,C or G
gactcnaaggatgaactgatnagacattttctattaggagtttggtaaaatattgnaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggacttttttttttnccccatgagaatccctttattttnggng

SEQ ID NO: 54289 - DNA, 393 bp, Homo sapiens
  misc_feature 6, 72, 82, 224, 300, 335, 339, 369: n = A,T,C or G
atagcnggaactgaatagagaccattagctttaatcatcattgaccttctcaagtcttcaccccagatgttnagtgataggnggaactgaatagagaccattagctttaatcatcattgaccttctcaagtcttcaccccagatgtttagtgataggaggaactgaatagagaccattagctttaatcatcattgaccttctcaagtcttcacccaagatgttnagtgatagaaggaactgaatagagaccattagctttaatcatcattgaccttctcaagtcgtcacccaagatgttnagtgatagaaggaactgaatagagaccattagctntaancattattgaccttctcttttactacatctnagcccactagccaggagtgacaga

SEQ ID NO: 54290 - DNA, 260 bp, Homo sapiens
  misc_feature 5, 10, 34, 40, 44, 49, 53: n = A,T,C or G
aattnggagnaaatatatatgtcaatatttagtnaagctnttcnttttnaatntccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 54291 - DNA, 393 bp, Homo sapiens
  misc_feature 5, 82, 359: n = A,T,C or G
gtctnaagtattttgtggaggctggtgctatggcagttagaagagttttaaaaagggaccttaaacgcattgccaaagcttntggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtaggggaagagagttttggagtcaaaatctggggttcccggtgggggtgctgnagaagcagccctttccatataccttgaaaactat

SEQ ID NO: 54292 - DNA, 321 bp, Homo sapiens
  misc_feature 2, 12, 32, 51: n = A,T,C or G
cngcccgatcangcaaaagatcttcaagaagngaaagagaccgaaaatcanacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaac

SEQ ID NO: 54293 - DNA, 204 bp, Homo sapiens
  misc_feature 4, 91: n = A,T,C or G
ccgngatacaccgatttgtcattttatattttagattatacctttgtccttccatgagtttgaattgaatggggagaaaagcaggagagcncctggtattaggtattttgaaaagtttgaaatagcagtctgagaagtgtttatgaagggaatggggaaaagaaaggaatgcaataatagaaaatgtttgttgcatacagcaga

SEQ ID NO: 54294 - DNA, 391 bp, Homo sapiens
  misc_feature 11, 17, 21, 27, 41, 51, 66, 69, 70, 82, 83, 103, 138, 142,162, 190, 198: n = A,T,C or G
gataccagttnagttanaacnttgcanctataattgagctntctcatctgncaaaggctatggatntcnnaaaaggttacanntctagatctatccaccttgnttttttattgtctacaaaccattaaatgtaaatancgtntttagagtcagtcattggcnttgcatttaccctttgagagttccacangaggtagnagagtgggttaacgtctttcctctagtactaccaggattcataaatggtaccccttactgtaatttgtcctcttagaagcagatcatctgatttatagaggattatgaaaaccagagtttttgaaaagcttattttatacatacgtattatatagagaaacaaatgttttattaaatggttcattgcccaagt

SEQ ID NO: 54295 - DNA, 400 bp, Homo sapiens
  misc_feature 5, 6, 31, 55, 57, 213, 299, 325, 327: n = A,T,C or G
ctgtnnagtatgggtcagcacctaggtcttnatgtggaagcattcaagtcaggcngnggtgatatatgtgtctcagaggctaccatagtatcattttagtgcttttattacaagtcatcaaacactgtatctgagaaacatgaggataaattatggtacattcaaaaactgctgataaatagcaaagaagagaacagggtactttgggaatanaaggccttttgcgtgagaaatgttttgtgctagctatgagtgaattttctacaagcagagaagttccatttggcctctgaactggntaacattttcttgatctttgcttagngnagcaaataaaattctgttattcttttggagagtcccaaaatatcttattgatttggatttgctttttcactta

SEQ ID NO: 54296 - DNA, 393 bp, Homo sapiens
  misc_feature 3, 6, 370, 384: n = A,T,C or G
agnccngaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagcatagataatagtacatgtcaccttaggtagtaggaagaattacaatttctttaaatcatttatctggatttttatgttttattagcattttcaagaagacggattatctagagaataatcatatatatgcatacgtaaaaatgggccacagngccttattggaggnggtaggtgc

SEQ ID NO: 54297 - DNA, 184 bp, Homo sapiens
  misc_feature 7, 10, 27, 30, 50, 66: n = A,T,C or G
aaattgnttnctataagcattcctttnatnctctattctatcctgggtcngcctcaaccgtgaganaggagagtctctggtactagctgctgtagcagtgcccttcatccagggcagttaatggagtcttggaccctttctttctctgggatccctgcccagcaccttcctatagagatgactt

SEQ ID NO: 54298 - DNA, 393 bp, Homo sapiens
  misc_feature 28, 48, 50, 91, 179, 191, 202, 232, 269: n = A,T,C or G
gattcctgccgccatcttggttccgcgntccctgcacaaaatgcccgncnaagccacagaaaccgtccctgctacagagcaggagttgccngcagccccaggctgagacagggtctggaacagaatctgacagtgatgaatcagtaccagagcttgaagaacaggattccacccaggcnaccacacaacangcccagctggnggcagcagctgaaattgatgaagaaccagncagtaaagcaaaacagaggcggagtgaaaagaaggcncggaaggctatgtccaaactgggtcttcggcaggttacgggagttactagagtcactatccggaaatctaagaatatcctctttgcatcacaaaaccagatgtctacaagaccctgcttcagat

SEQ ID NO: 54299 - DNA, 112 bp, Homo sapiens
  misc_feature 8, 13, 27, 33, 41, 53, 54: n = A,T,C or G
gaagccantgagncagccagcgcaggngcttcngctgaggnggcaggcgtagnntggaggaaaccgcagataagtgtttttctctttgaaagatagagattaatacaactac

SEQ ID NO: 54300 - DNA, 350 bp, Homo sapiens
  misc_feature 6, 16: n = A,T,C or G
catgtnaagattcagntagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagagagtgagcagtgttagcttagttctcttttgatgtaggtattatgattagctttgcactgtttcactactcagcatggaaacaagatgaaattccatttgtaggtagtgagacaaaattgatgatccattaagtaaacaataaaagtgccattgaaaccg

SEQ ID NO: 54301 - DNA, 398 bp, Homo sapiens
  misc_feature 2, 4, 26, 27, 41, 46, 58, 61, 64, 66, 76, 115: n = A,T,C or G
cngncgagacacatgcataagcgccnntcctttgaatgttncacgnaaacactgtcgnacngancntagcgctganaagaaacacgtttggtttggagagtccatggatggtggntttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggcaaatgaaggtgaattcaaggctgaaggaaatagcaaattcacctacacagttctggaggatggttgcacgaaacacactggggaatggagcaaaacagtctttga

SEQ ID NO: 54302 - DNA, 393 bp, Homo sapiens
  misc_feature 313, 325, 378, 385: n = A,T,C or G
caagacttgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgcccttgcacttctctgaatctgcctnttgtggattctngtgattttccttccaagggttcagttgtatgacagcagtattgacaataaaanggctttnaataattg

SEQ ID NO: 54303 - DNA, 391 bp, Homo sapiens
  misc_feature 6: n = A,T,C or G
caaacnggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggtctgcttcaat

SEQ ID NO: 54304 - DNA, 393 bp, Homo sapiens
  misc_feature 6, 83: n = A,T,C or G
aaggcngaacttggaaaataacattcatcagcttctacactgcactttttgtatgtggactttgtaaagtttaatgtccgttnaacagttgcttgtttatttgtgtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgcatttagacaaaattaatgtactgtgatattttcccactcttaagatgatgttgcccagcctagtactgcagaaattcagttctgatgctgtgtgtgcaagatattaatgtggccctgtaagaaataccag

SEQ ID NO: 54305 - DNA, 400 bp, Homo sapiens
  misc_feature 6, 15, 36, 82: n = A,T,C or G
accagngccgagtgnagagagcgagctagagtggcngtgtggtccgcgtctcgaaaaccggtagcgcttgcagcatggctgncaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggacgcaatgctatattaagtgctgcagaacttcgccatgtga

SEQ ID NO: 54306 - DNA, 173 bp, Homo sapiens
  misc_feature 4, 16, 32, 41, 157, 161: n = A,T,C or G
cctnaaaagccaaagnaatgggatacaatttnacagggacnttggaaaagacatgtttcctttgcattcatctctcaaacttagtttttatctttgaccaaccgaacatgaccaaaaaccaaaagtgcattcaaccttaccaaaaaaaaaaaaggantaantaaatacctttt

SEQ ID NO: 54307 - DNA, 393 bp, Homo sapiens
  misc_feature 19: n = A,T,C or G
gaccccggaacaaggtcgngaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgt

SEQ ID NO: 54308 - DNA, 224 bp, Homo sapiens
  misc_feature 2, 4, 27, 32, 33, 42, 66, 67, 81: n = A,T,C or G
cngncgaggccgccggtattaaaggcncagtnngttcaacgnttaaagtcctacgtgatctgagcnnagaccggagaaatncaggtcgggtttctatctacttcaaattcctccctgtacgaaaggacaagagaaataaggcctacttcacaaagcgccttcccccgtaaatgatatcatctcaacttagtattatacccacacccacccaagaacagggtttg

SEQ ID NO: 54309 - DNA, 303 bp, Homo sapiens
  misc_feature 5, 42, 49, 54, 60, 74: n = A,T,C or G
ccggngatgccgtagaatgactttgacaagatgacagaagtnggcttanaaatntcagtnataacaaacttctncaaggaagtttggaggatgttcaaacccatcgcaaagaagctaaaaaccttgaaaaaagattagacgaatggctaactagaataaacagtgtagagaagaccttaaatgacctggtggagctgaaaaccatggcacgagaactacgtgatgcatgcacaagcttcagtagccaatttgatcaagtggaagttcaagtgaatgaaatgaagcgagaagagaagtttagat

SEQ ID NO: 54310 - DNA, 104 bp, Homo sapiens
  misc_feature 2, 13, 32, 38, 59, 62: n = A,T,C or G
cngggcaagccanaaccacaaaaataatgaantgatgngaaatacaatgaagagtcaangtncatctcaaaatactgcttttacaaaagcagaataaaagcgat

SEQ ID NO: 54311 - DNA, 396 bp, Homo sapiens
  misc_feature 4, 27: n = A,T,C or G
ccgnggatgcccgtcaaggatggtttngggactagaggctcagtggtgggagagatccctgcagaacccaccaaccagaacgtggtggcctgaggctgtaactgagagaaagattctggggcttgtgttatgaaaatatagacattctcacataagcccagttcatcaccatttcctcctttacctttcagtgcagtttcttttcacattaggctgttggtcaaacttttgggagcaccggactgtcagttctctgggaagtggcagcgcatcctgcaggcttctcctcctctgtcttttggagaaccaggctcttctcaaggggctctagggactgccaggctgtttcagccaggaaggccaaaatcaagagtgagatgtagaaagttgtaaaat

SEQ ID NO: 54312 - DNA, 400 bp, Homo sapiens
  misc_feature 4, 5, 27, 35, 37, 38, 41, 53: n = A,T,C or G
atgnntcgcaccttcgtgaataccaanacctgctnanngtnaagatggccctngacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacggatgaccttgaataaaaattgcacacactcagtgcagcaatatattaccagcaagaataaaaaagaaatccatatcttaaagaaacagctttcaagtgcctttctgcagtttttcaggagcgcaagatagatttggaat

SEQ ID NO: 54313 - DNA, 397 bp, Homo sapiens
  misc_feature 9, 374, 384: n = A,T,C or G
tggggcttnggatccatttccatcggtccttacagccgctcgtgaagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgcaggatgttgcttcagagtgtgaagcaaatgcatgccaacattccagttttttaagaagggacaaaaggggggtgaattttctggagccaataaggaaaagcttgaagccaccattaatgaattagnctaatcatgntttctgaaaatat

SEQ ID NO: 54314 - DNA, 272 bp, Homo sapiens
  misc_feature 5, 8, 59, 72: n = A,T,C or G
gaggnggnctacaggcatgagccactgtgcccagctgacatattctcacttaatagaantatagagaaattnttcatgtttttctttttctctcccactttttcatattcctctttttcatttttgcctttccgtttctgtctatgatgtaggcttctgaggagaaccaagaagcttggctttagtggtagaatgacagaacttagggatcccttgcaggctagaacaaagttctgacccttagaccaaatctttatgttaagagttttcca

SEQ ID NO: 54315 - DNA, 249 bp, Homo sapiens
  misc_feature 3, 14, 37, 42, 48, 50, 52, 53, 61, 62, 67: n = A,T,C or G
cgnggccccctganaaaagagcaagagacagtgcgangaggnctggtngnannaagacganntgganatggaagaaaaagagggagtgtaagtcgaatctgaagtttgagcctgggacctggaaggcaatataatgtagtatattatagggattaaaaatcacctgacttgtgagtccagcatcttcacttactaggtgggatgaccctggagaatttatttaatcatttggcatctcagtttcctctg

SEQ ID NO: 54316 - DNA, 397 bp, Homo sapiens
  misc_feature 4, 5, 45, 49, 69: n = A,T,C or G
aggnnctgaggcagccagcgcaggggcttctgctgagggggcagncggncttgaggaaaccgcagatangcttgtttctctttgaaagatagagattaatacaactacttaaaaaatatagtcaatagggttactaagatattgcttagcgttaaggtttttaacgtaattttaatagcttaagattttaagagaaaatatgaagacttagaagagtagcatgaggaaggaaaagataaaaggttctaaaacatgacggaggttgagatgaagcttcttcatggagtaaaaaatgtatttaaaagaaaattgagagaaaggactacagagccccgaattaataccaatagaagggcaatgcttttaggattaaaatgaaggtgacttaaacaagctt

SEQ ID NO: 54317 - DNA, 391 bp, Homo sapiens
  misc_feature 6: n = A,T,C or G
gttacnttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatgacaacaaaatcagcagagttgatgcagctagcctgaaaggactgaataatttggctaagttaggattgagtttcaacagcatctctgctgttgacaatggctctctggccaacacgcctcatctgagggagcttcacttggacaacaacaagcttaccagagtacctggtgggctggcagagcataagtacatccaggttgcta

SEQ ID NO: 54318 - DNA, 393 bp, Homo sapiens
  misc_feature 29: n = A,T,C or G
ggtagcagggtgggtgtagatagcggcangcagaggggctcggagaggtagctctggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgt

SEQ ID NO: 54319 - DNA, 383 bp, Homo sapiens
  misc_feature 6: n = A,T,C or G
ggagcntaagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttacgaaaagaaggctgcgaagctgaagg

SEQ ID NO: 54320 - DNA, 256 bp, Homo sapiens
  misc_feature 7, 21, 27, 62, 255: n = A,T,C or G
aaatcanaaaagaaagaaatntgaaanaactttctctttgccatttcttcttcttctttttnaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagana

SEQ ID NO: 54321 - DNA, 272 bp, Homo sapiens
  misc_feature 15, 34, 38, 53, 112: n = A,T,C or G
gataccaacaatagngcttaccgacctcgatgtntggntcaggacatcccganggcgcagccgctattaaaggctcgtttgttcaacgattaaagtcctacgtgatctgagntcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgtc

SEQ ID NO: 54322 - DNA, 310 bp, Homo sapiens
  misc_feature 3, 20, 32, 41, 44, 45: n = A,T,C or G
cgngttttagcacagacttncctagtgtttgnactacacgnagnnagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattc

SEQ ID NO: 54323 - DNA, 393 bp, Homo sapiens
  misc_feature 33, 42, 66, 75, 242, 364: n = A,T,C or G
gagtcctttgaaccagaagatgttgaagacatnttggttacnatatatttttagaggcacaagaancccaaggtncaattgtggtctacttatcaagttaggagtgctgactggtcacttgaagctttactctacaaatgggatatgaagtgtgtccacattcctcttgagtcttttgatgcagacaaagaagatatagcagaatctacccttccaggaagacatacagttgaaatgctggncatttcctttgcaaaggacagtctctgaattatacctacaacctgttctgggacagtatcaatactgatgagcaacctggcacacaaactatgagcagaccacttcagcttgagaatgcagngggtctgaagatggcaagtctgtttgcct

SEQ ID NO: 54324 - DNA, 160 bp, Homo sapiens
  misc_feature 4, 14, 27, 39, 48, 95: n = A,T,C or G
ctgngtaggctggngctagggctcttngtttttggagtntggcaaganatgtcgtataagtgctgtgccagaagcggggggagggggggtttggnggaaattttttgttatgatgtctgtgtggaaagcggctgtgcagacgttcaattgttattattgc

SEQ ID NO: 54325 - DNA, 187 bp, Homo sapiens
  misc_feature 2, 3, 35, 40, 50, 52, 80: n = A,T,C or G
tnnctattttaaatatttttagtatgtactgtgtntgacncattaccatntngaggggatttatacatatttttagatanaattaaatgctcttatttttccaacagctaaactactcttagttgaacagtgtgccctagcttttcttgcaaccagagtatttttgtacagatttgctttctcttac

SEQ ID NO: 54326 - DNA, 397 bp, Homo sapiens
  misc_feature 7: n = A,T,C or G
tggccgngggtgcaatgtctcaagaataccccagccttctttgcggagaggcccaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctga

SEQ ID NO: 54327 - DNA, 398 bp, Homo sapiens
  misc_feature 4, 10: n = A,T,C or G
ccgnggattnccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaaggcaaggggacgcgagataaggtcctgatcagaatcatggctcccgcagtgaagtggacatgttgaaaattaaggtctgaattcaagagaaagtacggcaagtccctgtctattatatccagcaaga

SEQ ID NO: 54328 - DNA, 383 bp, Homo sapiens
  misc_feature 2, 4, 27, 35, 382: n = A,T,C or G
cntntcatacccaagctggaaacaatngaaatatntggtcttaaatcacttggtcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggcactaaaaataaaagtatatatgtaggaattaatgtactcttgctttgcaagctgtttgctatagtttccaaggtattatgttactctaactctgaaaagtgatgtaatctggtagcaatgtagtagtcaaataaaggcatttacnt

SEQ ID NO: 54329 - DNA, 338 bp, Homo sapiens
  misc_feature 103: n = A,T,C or G
atttccacttagatattttacatggttttgtttaaaattaccattacttgttttttaaaaacacatgaccacatatgtatatgtatatctacctaaacattgnatcatggtttcagtatgttattcatgtattactgggagatgctaccaagaaaccaacccaaagaaaattctgaaaaatacatttctatttatagaataaatgtttcatttatataaaagcaaaagaacttagagtctaataaatgggatgctaataaattatgaagttactgatttgaatatattatatttttataacttccttgccaaagcctgattagtacattagagacctg

SEQ ID NO: 54330 - DNA, 269 bp, Homo sapiens
  misc_feature 4, 26, 39, 177, 256, 259: n = A,T,C or G
aaantatatatgctgcaatctaatanttaaaaggaattntacctattatgaaacttattacattttttaagttagataatcagtttcaaaaggagtattcaggttatttaactttgtttttaaatggctgcatcagaaaaaaatgtctatttttttttattaaaatatttcatcacntgttaaaacatatttttgatctgagtttggtaaagtattattttacctgctgttggactaccacagactgttgactttnagntcttaaagag

SEQ ID NO: 54331 - DNA, 172 bp, Homo sapiens
  misc_feature 6, 21, 37, 39, 51, 56, 59, 60, 66, 68, 69: n = A,T,C or G
aagacngctaaagtgcaatantgtttgaagacaatangngggggtgtatcntgctnctnntaaganannctcttgtgtctttgctttatcttattagggagttgtatgtcagtgtataaaacatactgtgtggtataacaggcttaataaattctttaaaaggagagaactg

SEQ ID NO: 54332 - DNA, 388 bp, Homo sapiens
  misc_feature 6, 48: n = A,T,C or G
gaaacnataagggtatatttcatggagcctgtattcccttttcttagngtatttctgtcatgttctagtccccagacacaaagtagaagccatcaaagcctatgctaatacaggcaggaggacagaggttgatgctaacactgcttgaatgtatggatatctttgtcatatttatgtatgactgattatgaatcccttttgcttttcagtgtcttctcagaaaccaccaaccttgaaggtaatgaaactcccatttatcatgtgaacgagttaatgtatggctatgaaacatactttatttatttattatttcggttcaaattccattcagggtacaagtgacgagggaagattctgttttgggtatagccagagaaaacaaggatgg

SEQ ID NO: 54333 - DNA, 393 bp, Homo sapiens
gattccgtgatattgaataagtctcacaagatctgtttaaacctgaaggacatactactctctggagttgagaacatagcaatgagcctcaaagaagaaaatgagcctcagtgttcatggaggaaggtcattgcttagcaccttgggaagacatgcagctgatggatgaggaggatgctggatggctatgctgagttggctttagactctgctcaccagctttggaaatggttacccagaaagatgacaatatcctgataacccctccatgaccaaattcttcagcaaagcatttcaacaggccatcaccgggcatgtggctgatgggttgcacagctgttattatgtgcttacaagggaaattaggagtaattaatggctgggatcaataac

SEQ ID NO: 54334 - DNA, 300 bp, Homo sapiens
  misc_feature 7, 19, 299: n = A,T,C or G
tacacanaacaacatagangaacgtcagaaacatttatctttagtgaaagaagccagacacacacacacacacacacacaataataataattaatttttaatgataaaagtcagaaagtggttacttctgggaaagggacagagaatagactggaaagggacatgaaggagctctgaaatgatggacatactccagaccttgctttgcgtattggctataaagcatatataattggcaaaactcattgaactaaatatttaaaatgtatatattttattgtttataaattatacctcanc

SEQ ID NO: 54335 - DNA, 364 bp, Homo sapiens
  misc_feature 6, 50, 56: n = A,T,C or G
gcaggnacagatgtcgaatgctttactaaggtgtaaacggagaaacaganaaaatntacttcccccatccttttctgaaacttaataaattctaaagcagcaaaacaataattctgaaaatgagtgtatataacactttaaaactttattatcttttgcttggaattccccaaaatattgcaaagctcttccagtgaggcggcattccttctctaagttttacttagtcattacaaagaaaacaaaggctgggcatggtggctcacaccataatctcagaactttgagagaccaaggcaggaggattgcttgagaccaggagtttgagacccgcctggacaacatagtaaaaccctatctctat

SEQ ID NO: 54336 - DNA, 355 bp, Homo sapiens
  misc_feature 2, 5, 26, 41, 43, 55, 59: n = A,T,C or G
cnggnataacagacgaggtcgacgangcctcccttaccatnanatcaattggacnccantggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagc

SEQ ID NO: 54337 - DNA, 398 bp, Homo sapiens
  misc_feature 2, 21, 26, 27, 32, 33, 40, 41, 44, 45, 51, 58, 59, 61, 67,71, 72, 78, 79, 85, 90, 99, 207: n = A,T,C or G
cngggaatccccggtcgaatngcggnngcacnnattgccnngcnnaagtcnagactcnncnggtgcnacanngcaganntggccngcagncccaggctngatacagggtctgggaacagaatctgacagtgatgaatcagtaccagagcttgaagaacaggattccacccaggcaaccacacaacaagcccagctggcggcaggcangctgaaatcgatgaagaaccagtcagtaaagcaaaacagagtcggagtgaaaagaaggcacggaaggctatgtccaaactgggtcttcggcaggctacaggagttactagagtcactatccggaaatctaagaatatcctcttttgcatcacaaaaccagatgtctacaagagccctgcttcagatactta

SEQ ID NO: 54338 - DNA, 249 bp, Homo sapiens
  misc_feature 48, 60, 88, 248: n = A,T,C or G
cccgggaagacagataaatttctgcaggacagcctataaaattgtggnactttttgatgnttcagtaaacttgacattgtcagagttncaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacng

SEQ ID NO: 54339 - DNA, 400 bp, Homo sapiens
  misc_feature 3, 15, 34, 68: n = A,T,C or G
gtncgcaagtcccanacgctgcccatggaggcgnccagcgagccgccgctggatgctaagtccgatgncaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagcatggcttcactttcggcaacaaaactaaataaggatggacatttattgaatgaaaaatgcacttttgtttttccatt

SEQ ID NO: 54340 - DNA, 107 bp, Homo sapiens
  misc_feature 68, 69, 90: n = A,T,C or G
ggctccttcttttccctcttaagagttctattcttcaggtagataatttttcaaatgtgaattatctnntgtgtctatattgatagctcntaaaggagtgaaaatct

SEQ ID NO: 54341 - DNA, 393 bp, Homo sapiens
  misc_feature 6, 134, 142, 154, 266: n = A,T,C or G
cttgcntgccagcaaatgactatagctggggcagtggttacttgttatttcaacagaagtaaaaatgatcctcctgatcatcccatcctttcgtctctctccattctcttcttctaccatcaaggaaccgttgngaaagggncatttttaatcnctgtggtgaggattccgagaatcattgtcatgtacatgcaaaacgcactgaaagaacagcatggtgcattgtccaggtacctgttccgatgctgctactgctgtttctgggncttgacaaatacctgctccatctcaaccagaatgcatatactacaactgctattaatggggcagatttctgtcatcaagcaaaagatgcattcaaaatcttgtccaagaactcaagtactttacatc

SEQ ID NO: 54342 - DNA, 379 bp, Homo sapiens
  misc_feature 2, 61: n = A,T,C or G
cngggataacgaattaactagaaataactttgcaaggagagccaaagctaagacccccganaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 54343 - DNA, 393 bp, Homo sapiens
  misc_feature 351, 373: n = A,T,C or G
gattacaagcagcaacatcatgatagtgattgattttgtgattatacaataggatggaattaaaacaaaatggaagagattattggcttagagtgttctaaagtctttctattctttgggaggtagatagagatatttgttaactttagactttgaaattcacatttgcatgatcaagttgtaagtatcatcactaatacaaatgaactgtataattttcaaaccaataaagtgctcttaaaaagctctgtgttctagtgcagttgacaaagtatttcacagcaccagagccaacgtttttctacctgttttataaaagatcctccccatcctccaagcagacttagaggntttctcctctctgctcttgggnatcttggccaaatctttaga

SEQ ID NO: 54344 - DNA, 185 bp, Homo sapiens
  misc_feature 2, 22, 26, 28, 62, 88, 90, 102: n = A,T,C or G
cnggggaggcccgaagagaaanagangnatggatcagagcattgtgcaatacagtttcattnaactccttccctcgctcccccaaaantntgaatttttttncaacactcttacacctgttatggaaaatgtcaacctttgtaagaaaaccaaaataaaaattgaaaaataaaaaccataaacat

SEQ ID NO: 54345 - DNA, 224 bp, Homo sapiens
  misc_feature 33, 46, 54, 72: n = A,T,C or G
caaacagatggcaatatgctgggcatctacttnaaaacaaagttgnctgatttntgcaagagagggtaggantttattgttcttatttccctttacagttctgcagttccatcacagtatttttttaaataactcaggtgtatgagaagaaattagaaaagaaaattaacttatgtggactgtaaatgttttatttgtaagattctataaataaagctatattc

SEQ ID NO: 54346 - DNA, 378 bp, Homo sapiens
  misc_feature 6, 15, 34: n = A,T,C or G
caaganaaggagggnatcccacctgaccagcagngtctgatatttgccggcaaacagctggaggatggccgcactctctcagactacaacatccagaaagagtccaccctgcacctggtgttgcgcctgcgaggtggcattattgagccttctctccgcagcttgcccagaaatacaactgcgacaagatgatctgccgcaagtgctatgctcgccttcaccctcgtgctgtcaactgccgcaagaagaagtgtggtcacaccaacaacctgcgtccaagaagaaggtcaaataaggttgttctttccttgaagggcagctcctgcccaggccccgtggcctggagcctcaataaagtgtcctttcattgactggaac

SEQ ID NO: 54347 - DNA, 340 bp, Homo sapiens
  misc_feature 57, 61: n = A,T,C or G
atttcagatacttgaagaatggtgatggtagctagaagaatttgagaagaaatactnctgnattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttggcaagcagaaaaattaaattgtacctattttgtatatgtgagatgtttaaataaattgtgaaaaaaatgaaataaagcatgtttggttttcc

SEQ ID NO: 54348 - DNA, 310 bp, Homo sapiens
  misc_feature 4, 11, 38, 309: n = A,T,C or G
ccgngggatcnggagactggcaacctgaaaaaggctgncattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaang

SEQ ID NO: 54349 - DNA, 399 bp, Homo sapiens
  misc_feature 9, 216, 300: n = A,T,C or G
ctctttagntctttgcaagaaggtagagataaagacactttttcaaaaatggcaatggtatcagaattcctcaagcaggcctggtttattgaaaatgaagagcaggaatatgttcaaactgtgaagtcatccaaaggtggcccggatcagcggtgagcccctatcctaccttcaatccatcctcggatgtcgctgcttgcataaggccataatggntaaaggtgtggatgaagcaaccatcattgacattctaactaagcgaaacaatgcacagcgcaacagatcaaagcagcatatctncaggaaacaggaaagcccctggatgaaacactgaagaaagcccttacaggtcaccttgaaggaggtggtttaagctctctaaaaactccagcggcaatt

SEQ ID NO: 54350 - DNA, 393 bp, Homo sapiens
  misc_feature 5: n = A,T,C or G
ggaanaccatggcatagagaaggagaggtgagacttgctggaatgacacttacttacgacccaactacggctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcaagctatgcaaggagcctacttgccacaagtatg

SEQ ID NO: 54351 - DNA, 398 bp, Homo sapiens
  misc_feature 4, 10, 369: n = A,T,C or G
ccgnggcatncctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagcacccaaacacttctgctttcacttaaggnctggcccgcaatactgtaaggaacaagca

SEQ ID NO: 54352 - DNA, 259 bp, Homo sapiens
  misc_feature 4, 9, 33, 39, 40, 52, 64: n = A,T,C or G
attnggagnaaatatatatgtcaatatttagtnaagctnntcttttttaatntccaggaaaaantaaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 54353 - DNA, 393 bp, Homo sapiens
  misc_feature 6, 17, 27, 83: n = A,T,C or G
ataacnaaagtatgatnagaaaatatntataaaacagaccccctaatagcaatagtactgcaatgtgtctaattaaaggagtntcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacaggtgggctaaaataatgatgatatcaggggtaaacatatttttttgagaagtg

SEQ ID NO: 54354 - DNA, 226 bp, Homo sapiens
  misc_feature 5, 10, 30, 47, 51, 52, 53: n = A,T,C or G
gaggntctcnactggtttgactgagctganccaagaactaaagctgnggcnnngaatggaaaacctggccacctgcagttttattctctccagagtgataaacagttatacaatttagatattatacagcaagaatatattaatgattatggtctgatccaaattgaactaacaaaggctgcgtttggctgctttggtaactggcttgcaacagtggaacagcggc

SEQ ID NO: 54355 - DNA, 187 bp, Homo sapiens
  misc_feature 6, 16: n = A,T,C or G
gaggcnttgaggcagncagccgcaggggcttctgctgagggggcaggcaggagcttgaggaaaccgcagataagtttttttctctttgaaagatagagattaatacaactacttaaaaaatatagtcaataggttactaagatattgcttagcgttaagtttttaacgtaattttaatagcttaaga

SEQ ID NO: 54356 - DNA, 210 bp, Homo sapiens
  misc_feature 2, 14, 35: n = A,T,C or G
gngaataaaacganttaaatatatgtacacacgcntgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaac

SEQ ID NO: 54357 - DNA, 244 bp, Homo sapiens
  misc_feature 4, 27, 41: n = A,T,C or G
ccgnggcgaccaagttttttaaattgntcttttattgtttnaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggattcatgtgaaattaaagcagattctctagcagtt

SEQ ID NO: 54358 - DNA, 393 bp, Homo sapiens
  misc_feature 376: n = A,T,C or G
gaatcctataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgnattacagtattaaaact

SEQ ID NO: 54359 - DNA, 398 bp, Homo sapiens
  misc_feature 3, 11, 32, 41, 45, 52: n = A,T,C or G
gantacctgtncatttttggcccggataggcnttgagtgcngccngcgcagnggctttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattaagaaaaaagacaagctaggaaacaaaaagctaagggcaaaatgtacaaacttagaag

SEQ ID NO: 54360 - DNA, 185 bp, Homo sapiens
  misc_feature 2, 8, 12, 18, 19, 23, 39, 44, 46, 47, 50, 56, 61, 73, 77,147: n = A,T,C or G
gnatttcnaacngattgnnttgnaaaaactcctagtatntcagnannaangcctgntgtgngatgaacctccngaancttctatctgttcttttttgaggctcagggagaaactagcatttttttttttccaaactactttttgtcnctgtgacagttgtaaataaagtttgaaaatgctttcga

SEQ ID NO: 54361 - DNA, 398 bp, Homo sapiens
  misc_feature 1, 90: n = A,T,C or G
ncgggggatcccaggccagagacaaggcagacaaaggttcatttgtaaagaagctccttccagcacctcctctcttctccttttgcccanactcacccagtgggtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgcaatgccaggatcatttctgggatgggaagggatgtgagatgatctggtactgcaacttcagcgaattgc

SEQ ID NO: 54362 - DNA, 347 bp, Homo sapiens
  misc_feature 9, 16, 34, 40, 41, 47: n = A,T,C or G
aattgaaangagatcntgagcttgcttcttgggnccgtanncaagangaatgtgagcgcagggggcgagcagggaaaacacagtccactccccaccaccactccgctccttccacagcaaatgggggctgctcagaaaaccctatcctttcttttcctctcttcaaaggcaggcatgtgattgaggatgtgatggtgacttctgcctgttttattttgtggaacttcactttagtcagggaaataattggaatatctttaatctgatgtagtttgacctttagaaattgaaagtgaaacagctattgttgataattcacaaagtattaataaaacttctattacctg

SEQ ID NO: 54363 - DNA, 393 bp, Homo sapiens
  misc_feature 203, 264, 281, 308, 338: n = A,T,C or G
ggagccatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggncagtcatttcaagggacaataaataaagtagaaaaggatgaactgttttgcatatttctgnggaagaacggaaaacanactttgagaggtcggaaaattcactgnacagaatgacagcttatatacactatctgngcaatttttcttggctgggggaatttaaatgcaagagctcctccaaaataagaag

SEQ ID NO: 54364 - DNA, 400 bp, Homo sapiens
  misc_feature 5, 385, 387: n = A,T,C or G
aattngatcataagaagtccttggagaagtatttgcggaattactgaaacttttttaaactacattggggagtaaaaataaccttcagcttggattgaggttagacctgagaattatttatcatctttttcctttattattaagtattgtcattttaatcaagattattccttcaacaatgctagatattaaaaacagttccagtctttatattttcccaggtaattaattttttggcaaatgaaaagaggcactaaacgcatattatttggaatattgcctgacttaaatgcatataatgtatcaaaaacaggcctctactgtgtacatttgcatcgaaaacatcaactggttttttctctttgcctgctgctccaatcagagngnctcaaacgtaaga

SEQ ID NO: 54365 - DNA, 398 bp, Homo sapiens
  misc_feature 1, 10, 57: n = A,T,C or G
ncggggagancatcacttatacactaagaaagacaggaagaaggcagaaaggaaganaggactaacaaaacaaccagaaaacaaataagaaaatggcagtagtaagtccctccctgtgaataatgacgttgaatataaatggactaaattctcccatcaaaagacatagattggctgaacggatgaaaaagattgaaaaaaagagccaattatatgctacctataagaaactcatttcacctgtaaagatgcacatagactgaaaataaaggggtagaaaaagttattctatgcagtggaaatgtaaaaagagcaggagtagctgtatatgtatcagataaaatagatttcaagacaaaaattgtaaaaagagacaaggaaggcattatacaatgata

SEQ ID NO: 54366 - DNA, 389 bp, Homo sapiens
  misc_feature 1, 5, 68, 317: n = A,T,C or G
ngaanatcgaacacgcaaggctgtgagactacctattgtaggatattgcaccctatgacattggtggncctgatcaagaatttggtgtggacgttggccctgtttgctttttataaaccaaactctatctgaaatcccaacaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgtccaccaaatacaattcaaatgctttttgntttatttttttaccaattccaatttcaaaatgtctcaatggtgctataataaataaacttcaacactcttta

SEQ ID NO: 54367 - DNA, 324 bp, Homo sapiens
atacccgaaaacataataaagataagctcagttcttcattgggaaaaaatatttttaaagaaaatttagaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactgctgctcctaaactggtttccagtcatgtcctccagtatgtgatttttataaattaaaggtaatattgtatattaaagtcaaataaagatgtctttaagtg

SEQ ID NO: 54368 - DNA, 397 bp, Homo sapiens
  misc_feature 5, 54, 55, 347, 349, 351: n = A,T,C or G
cgaanagtccgagtggagagagcgagctgagtggttgtgtggtccgcgtctcgnntaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgngngnttgataaggatggcaatgctatattagtgctgcagaacttcgccat

SEQ ID NO: 54369 - DNA, 374 bp, Homo sapiens
  misc_feature 4, 11: n = A,T,C or G
cggnaagaccnagcagaagaaaaaagacaagctaggaaacaaaaagctaagggcattttgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaagggaaggcg

SEQ ID NO: 54370 - DNA, 398 bp, Homo sapiens
  misc_feature 1, 12, 90, 129, 301, 363, 379: n = A,T,C or G
ncgacagtaccngtgtgaggaataagagtaagtaatgatttcagagttccttgccatcccctcaggaatactaaagagtagcccagatgnatggagggaacactgaacttgaagtcacaaagtcttggnctagcctgtgtcactcactagctatgcaaccttggcatatctgtttattacctcttttgattgtgctttctccatctctgaagaaatagggatggggttaataatgatttcacgtgcctatcttacatgaggtaaaagctaaatgaatgattatatatgtaaaagggtttgncaagtattaggcaacagtaaggcattcagctactgaggggaatcagaatgcttggaatcagncttcatttttggctgncccaagacatagatgcaga

SEQ ID NO: 54371 - DNA, 235 bp, Homo sapiens
  misc_feature 3, 16, 33, 51: n = A,T,C or G
canacctaccgagccnggtgacagctggttgtncaagatagaatcttagtncaactttaaattcgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 54372 - DNA, 398 bp, Homo sapiens
  misc_feature 87, 355, 358, 396: n = A,T,C or G
ccggagagacccgccacggtttcggtagcgacggtagctctagccggcctgactgtgctagcacctcccccaggagaccgttgcagncggccagcccccttctccacggtaaccatgtgcgaccgaaaggccgtgatcaaaaatgcggacatgtcggaagagatgcaacaggactcggtggggtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggcaagnggncattcttctgttcaaatctgggtaaaagcatggactgngc

SEQ ID NO: 54373 - DNA, 356 bp, Homo sapiens
  misc_feature 5: n = A,T,C or G
cattncaagagaaaaagacaggacacgctttccatcgttcagtatttgatgacacaaaattccagttctaacgttgggcatcaacttctagcactacgagtgtggctcccacttggacaagataccgagcttcgttatgcagtttttaatattatttattattttaaaaagtaataagcacaaaactacatacattgtatgtcatttaaagtatttatgtcaaacagggtgcaagtgtgaacccaaggactggagcacaaattcctaactgcctggggcagggctagtgttagcattggtgtgcgctgcctccaaaggaggtctagttgcagcgagactcaacacagatgacattg

SEQ ID NO: 54374 - DNA, 397 bp, Homo sapiens
  misc_feature 4, 53: n = A,T,C or G
cgangaggcctgaggcagccagcgcaggggcttctgctgagggggcaggcggntcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaggattaaaatgaaggtgacttaaacag

SEQ ID NO: 54375 - DNA, 400 bp, Homo sapiens
  misc_feature 8, 16, 40, 56, 58, 89: n = A,T,C or G
cggactgncccggagngatagtaacaccttcagaaaaggnttatgagaagccactnanagaagaaggaaggagaggaagaagaggagantacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctga

SEQ ID NO: 54376 - DNA, 387 bp, Homo sapiens
  misc_feature 16, 29, 31, 32, 33, 34, 51, 116, 293: n = A,T,C or G
ctggaagaaagtattngaaatcatctaantnnnncacatggagcaggaacnggagtaaatgcaatactgtgttgtaatatcccaacaaaaatcagacaaaaaatgggaacagacgnatttggacactgatgggcttaagtatggaaggaagaaaaataggtgtataaaatgttttccatgagaaaccaagaaacttacactggtttgacagtgggcagttacatgtcccacagttccaatgtgcctgttcactcacctctcccttccccaacccttctctacttggctgctgntttaaagttgcccttcccaaatttggatttttattacagatctaaagctctttcgattttatactgattaaatcaggactgcagtatttgatta

SEQ ID NO: 54377 - DNA, 154 bp, Homo sapiens
  misc_feature 21, 48, 56, 60, 63, 69, 72, 80, 85, 90, 92, 97, 103, 109,145, 150: n = A,T,C or G
ggaaacagcaagcattatggncaaacagcaaaggccataaccttttgngatttttntttnttnaaaacnctnaagggacngtggnaattncncatanggggcnggaaanggttgggctttgaaacatttgaagggttcccatggnagcgngagc

SEQ ID NO: 54378 - DNA, 393 bp, Homo sapiens
  misc_feature 352: n = A,T,C or G
actcgcggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggctcaacttggccattcagaatggaccaattaaaagcaatgggcaggagggacccttgctcggtaccgatagcactgcaatgttaggactggattatggaaacacgaactactgtgtaacattgctggcttcctaggcagaaattcatataaactgngatactcacattccttgaagctatgagcatttaaaactggt

SEQ ID NO: 54379 - DNA, 300 bp, Homo sapiens
  misc_feature 5: n = A,T,C or G
atggncattctgctcagatagaatgacagtccgtcaaaacagattgtttgcaaaggggaggcatcaagtgtccttggcaggctgatttctaggtaggaaatgtggtagcctcacttttaatgaacaaatggctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctat

SEQ ID NO: 54380 - DNA, 394 bp, Homo sapiens
  misc_feature 1, 5, 180, 215, 230, 279, 346, 367, 390: n = A,T,C or G
ncganggggccgtaggtaagtttgttgggccgggttctgaggccttgcttctctttacttttccactctaggccacgatgccgcagtaccagacctgggaggagttcagccgcgctgccgagaagctttacctcgctgaccctatgaaggcacggtgtggttctcaaatataggcattcngatgggaacttgtgtgttaaagtaacagatgattnagtttgtttgggganaaaacagaccaagctcaagatgtaaagaagattgagaaattccacaagncaactaatgcgacttatggtaagccaaggaagcccgcaatggtaccatggagactgagtgaatgggnttgaaatgaagactttggcgngacctaagaaggaaatatcttcngaat

SEQ ID NO: 54381 - DNA, 398 bp, Homo sapiens
  misc_feature 1, 4, 142, 193, 246, 290, 351, 360: n = A,T,C or G
ncgnggaaaccaattaaactccagtggtttatttattaatattaatttacaacctgatggcttaatcagtatcctgctttcttttttttctttaaagacttggcataattttacatagccttgtgattgctttgaaaaggcngtagtgttcttccatcattagatgacaattttcttttctagtttgaaaacntagtttaagttctcaagtcaatatgcctatagtgaaccatttattgaaggggngtcattgcgaataagcatggccaattaaatgaagaataattggnttaggccgagcaccttgcaatacttctctgggttagaatactgcagaaacccaatggtctntctcatgcnggggggggattttgctttggttaaaacctgagggccct

SEQ ID NO: 54382 - DNA, 269 bp, Homo sapiens
  misc_feature 4, 14, 48: n = A,T,C or G
ccgngggctgccgntatgaaaatatagacattctcacataagcccagntcatcaccatttcctcctttacctttcagtgcagtttcttttcacattaggctgttggttcaaacttttgggagcacggactgtcagttctctgggaagtggcagcgcatcctgcagggcttctcctcctctgtcttttggagaaccagggctcttctcaggggctctagggactgccaggctgtttcagccaggaaggccaaaatcaagagtgagatgta

SEQ ID NO: 54383 - DNA, 344 bp, Homo sapiens
  misc_feature 8, 38, 51, 55, 90: n = A,T,C or G
gaaaacgnccctgagacatcaccgccaagctgggcatnggggagatggccngagncttgaccccaagaccgtgcaggacctcacctcggnggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttcaagccaagagaagatcgaatgggtttttg

SEQ ID NO: 54384 - DNA, 185 bp, Homo sapiens
  misc_feature 4, 19, 37, 43: n = A,T,C or G
tatnaaaggatcaagacanatgagatctaatactacnggcagntttaatgtccactgtgttttatacagtatctttttttgttcactttggaaatttttactaaaaattgcaaaaaataaagtattgtgcaaagatgtaaggttttttgaaacttgaaatgcattaataaatagacgattaaatc

SEQ ID NO: 54385 - DNA, 342 bp, Homo sapiens
  misc_feature 1, 4, 55, 314: n = A,T,C or G
ncgnggagtccgagtggagagagcgagctgagtggttgtgtggtcgcgtctcggntaccggtagcgcttgcagcatgctgaccaactgactgaagacagattgcagaattcaaagaagctttttcactatttgacaaagatggtgatggaactataacaacaaaggaattgggaactgtaatgagatctcttggcagaatcccacagaagcagagttacaggacatgattaatgaagtagatgctgatggtaatggcacaattgacttccctgaatttctgacaatgatgcaagaaaaatgaaagacacagacngtgaagaagaaattagagaacatccggg

SEQ ID NO: 54386 - DNA, 211 bp, Homo sapiens
  misc_feature 5, 22, 33, 36, 37, 50, 54, 55, 57, 59, 60, 61, 63, 66, 86,210: n = A,T,C or G
actgnctatgcttttgaaatcntctcttgtaanacnntcagaaaacaaanccanngnannngnganggcgggacctgtcttcaaantctcattagaattttttcactggaggaagattttcccttgcttctgcataaaattttaactccataacttataagctcactctttattgttactttctaattgacaaataaaaattgtatcttng

SEQ ID NO: 54387 - DNA, 146 bp, Homo sapiens
  misc_feature 9, 13, 28, 42, 46, 47, 49, 52, 62, 71: n = A,T,C or G
gccctcganaggnaggcgccaccaagangcagcagcagcagnaacnntntgngtagccagtntaccaccancacagcaccccagacagctaggcttagcccctctgccctcctttcattgtactttatcattaaaaatcaacttcc

SEQ ID NO: 54388 - DNA, 385 bp, Homo sapiens
  misc_feature 4, 55, 56, 302: n = A,T,C or G
cagngaggccctgaggcagccagcgcaggggcttctgctgagggggcaggcgggnncttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgnatttaaaagaaaattgagagaaaggactacagagccccgaattaataccaatagaaggcaatgcttttagattaaaatgaagg

SEQ ID NO: 54389 - DNA, 400 bp, Homo sapiens
  misc_feature 2, 8, 43, 53, 335, 363: n = A,T,C or G
anttcccngaggaagacgcggcccgtaaggtctgaggattttngggccgcacnctcctgctcctgactcaccgctgttcgctctcgccgaggaacaagtcggcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgnggggaaggtctaagacgtgggatcgttncagatgagaattcacaagcgactcaatgacttgcaca

SEQ ID NO: 54390 - DNA, 112 bp, Homo sapiens
  misc_feature 25, 28, 30: n = A,T,C or G
aaagatggctgcgcccaggtaattngantnaaggccacagtgaactccggcgtggctgaggaaggaggaggcacccacaggctgctgggaggagagcataaggctcaaaatg

SEQ ID NO: 54391 - DNA, 393 bp, Homo sapiens
gagctccgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatctggccattaagagatgcaagcattttgactgggaggagataagaagagaaaggccaag

SEQ ID NO: 54392 - DNA, 156 bp, Homo sapiens
  misc_feature 8, 14, 37, 56, 73, 115, 154: n = A,T,C or G
acttgtgntggctngcggaaggccagctcgaggctancttttgccatgacaacttntaattgccatgtacagnatgttcaaagtcaaataactcctcattgtaaacaaactgtgnaactgcccaaagcagcacttataaatcagcctaacatanga

SEQ ID NO: 54393 - DNA, 191 bp, Homo sapiens
  misc_feature 11, 19, 54, 55, 64, 75, 76: n = A,T,C or G
atactacggcnaacgctcngaaatctgtggagcaaaccacagtttcatgcccanngcctagaantaattcccctnnaaatctttgaaatagggcccggatttaccctatagcaccccctctaccccctccagagcccactgtaaagctaacttagcattaaccttttaagttaaagattaagagaaccaac

SEQ ID NO: 54394 - DNA, 385 bp, Homo sapiens
  misc_feature 354, 357: n = A,T,C or G
gccttagcgccatttttttggaaacctctgcgccatgagagccaagtggaggaagaagcgaatgcgcaggctggaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggcctctgcctggacctgtgacattctggactattctgggttaatttgnggncgagtgtacaaccatataataaatcacc

SEQ ID NO: 54395 - DNA, 285 bp, Homo sapiens
  misc_feature 2, 6, 49, 68, 101, 274, 280: n = A,T,C or G
angatntctatgaacttgtcttattttaatggcggggtcttttttctgngaagatttgggatccaagncgcatcatgcccacttgtgactttgagattatncatcaagaatgaggatatagtagccatgacatagcttgagctatagcctttaatcccttacttcggctgtggggggagggtgagtttgaaaatgttctgattttcttgtaacctgggaaagccatgaccttgtgcccgattctttcagattgctttgggtaataaatattggngggggnatccg

SEQ ID NO: 54396 - DNA, 146 bp, Homo sapiens
  misc_feature 4, 11, 54, 88: n = A,T,C or G
cganggtgccnaaggaccaagatggcggccgcaaactgacacctcagggacaantagatctggacagaatcgccggacaggtggcagngtgccaacaagaagcattagaacaaaccatgctgggttaataaattgcctcattcgtt

SEQ ID NO: 54397 - DNA, 279 bp, Homo sapiens
  misc_feature 2: n = A,T,C or G
cnggaaacaagtttatatttataggtttcaataaacaaggtaagagcaatattaaaccttcaggttatttgtgttagcagtcatgagacttctaattcatcattgtcaagacaatatcaaggctttatttttttttcaaaatttcattgcaaataacagcaaatacaataaaggtttcaacagtatgtatatggaaatagatagcaacttaccttttctctgcttcttgaacagaaacaatggccttgggtaaatacctacactcacttttcagtaatg

SEQ ID NO: 54398 - DNA, 393 bp, Homo sapiens
  misc_feature 6, 36, 69: n = A,T,C or G
accgtngggcatgctgataccatcccaatagctgtngcccattgacctctagtggtgagtttctagaanactggccattcatgagatattcaagattcaagagtattctcacttctgggttatcagcataaactggaatgtagtgtcggaggatactgtggcttgttttgtttatgtttttttttcttattcaagaaaaaagaccaaggaataacattctgtagttcctaaaaatactgacttttttcactactatacataaagggaaagttttattcttctatggaacacttcagctgactcatgtattaaaataggaatgtgaatgctatatactctttttatatcaaaagtctcaagcacttatttttattctatgcattggttggcttt

SEQ ID NO: 54399 - DNA, 400 bp, Homo sapiens
  misc_feature 11, 16, 34, 270: n = A,T,C or G
cccggggacgntgtcngcaggcactcagaatggnccagcgatatgacatacgcgacggaggctttcctacaatacagcctctaacaaaactagactgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcaggcctatggtggntccatgtgtgctaaatgtgttcgtgacaggatcaagcgtgctttccttatcgaggagcagaaaatcgttgtgaaagtgttgaaggcacaagcccagagcaggaaagctaaataaaaaaatgaaacttttt

SEQ ID NO: 54400 - DNA, 111 bp, Homo sapiens
  misc_feature 19, 35, 41, 76, 92: n = A,T,C or G
gaggaagaagagaagtacngaaataccgattattntttctntatctttctgatacaatgatcatttgaccaaggcnacacacaagccagganacatttggaaattagcatc

SEQ ID NO: 54401 - DNA, 229 bp, Homo sapiens
  misc_feature 220, 221: n = A,T,C or G
aattacagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcaggggcctttttnnttttaagg

SEQ ID NO: 54402 - DNA, 400 bp, Homo sapiens
  misc_feature 5, 8, 38, 292: n = A,T,C or G
gaganccngcgaaaggcgagagctgcgaagggccaggngtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgngctaaggctggaatgtgttgagcctaactgcagatccaagaggatgctgccattaagagatgcaagcattttgactgggaggagataagaagagaaagggccaaggga

SEQ ID NO: 54403 - DNA, 398 bp, Homo sapiens
  misc_feature 5, 272, 373, 376: n = A,T,C or G
ccggnaaggccccgtgtgtttgaagtgagtcttgctgatttgcaagaatgatgaagttgcatttagaaaattcaagctgattactgaagatgttcagggtaaaaactgcctgactaacttccgtggcatggatcttacccgtgacaaaatgtgttccatggtcaaaaaatggcagacaatgattgaagctcacgttgatgtcaagactaccgatggttacttgcttcgtctgtctgtgttggttttactaaaaaacgcaacaatcagatacnggaagacctcttatgctcagcaccaacaggtccgccaaatccggaagaagatgatggaaatcatgacccgagaggtgcagacaaatgacttggaaagaagnggncaataaattgattccagacagc

SEQ ID NO: 54404 - DNA, 333 bp, Homo sapiens
  misc_feature 29, 44: n = A,T,C or G
cccatttctctcctcccttcagacccatnattgagaacaaatgnaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactc

SEQ ID NO: 54405 - DNA, 226 bp, Homo sapiens
  misc_feature 1, 3, 46, 53, 61, 214: n = A,T,C or G
nanaaatctcccttttgggacctcccatctttctgttttgaaaagngtacagnagtgcagngttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggantttaggtgggat

SEQ ID NO: 54406 - DNA, 363 bp, Homo sapiens
  misc_feature 43, 286: n = A,T,C or G
aaggagtcagacattttaagatggtggcagtagaggctatggncagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggctggactgttttctctcggctccccatgtgtcctggtcccgtttctccacctagactgtaaacctctcgagggcagggaccccaccctgtactgnctgggctttcacaagctcctccacaatgctgaatatacagcaggtgctcaataaatgattcttagtgactttacttg

SEQ ID NO: 54407 - DNA, 398 bp, Homo sapiens
  misc_feature 4, 6, 50: n = A,T,C or G
aaancnatgaaagtaataggatattctcaatatagtccataaggttgtangaaagtattgaacaaataaataagtgagggagaaaagaaagctctttcttaacagtaagaatgccaattaagaggaatgatggaaatagaaagtcaccatttggtaaacaccacagtcataatagtttcaggcaagaatcatcaaatggatgctaaatttgtgggtgaaaatataatgataaataggatatttacagagtatcaacatatctcctctcaaaatacttattaattataaaaggaaagtagtaactttacagtggaaaaacctggcagcaccacctaaaacaaatgatcaaaggtaacatcacccagtaatgagatatatcaccatcatgtgcctctcat

SEQ ID NO: 54408 - DNA, 109 bp, Homo sapiens
  misc_feature 5: n = A,T,C or G
tgaanaaggagaattgcttgagccagggaggcagaggttgcatgttgagttgagattacgccactgcactccagcctgcgtgacagaacgagccacaagcctttatctc

SEQ ID NO: 54409 - DNA, 249 bp, Homo sapiens
  misc_feature 198, 212: n = A,T,C or G
ggttgcaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggnccttttggcccctnggatagttaacagctgagtaattctaatctcttctgt

SEQ ID NO: 54410 - DNA, 335 bp, Homo sapiens
  misc_feature 11, 16, 50, 51: n = A,T,C or G
caccttgaatnaaaantgcacacactcagtgcagcaatatattaccagcnngaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggtctgcttcaataaatctttggaaaaacccaac

SEQ ID NO: 54411 - DNA, 231 bp, Homo sapiens
  misc_feature 4, 28, 29, 39, 58: n = A,T,C or G
gaanattccttaagaaagcagttgctgnncgaaagcatnttgagaggaacagaaaggntaaggatgctaaattccggctgattctaatagagagccggattcaccgtttggctcgatattataagaccaagcgagtcctccctcccaattggaaatatgaatcatctacagcctctgccctggtcgcataaatttgtctgtgtactcaagtaataaaatgattgtttaact

SEQ ID NO: 54412 - DNA, 228 bp, Homo sapiens
  misc_feature 5, 22, 224: n = A,T,C or G
gaatntccttgcatatgtgttngtccagatgtcataattccaaatctgtgaaaggcaaaagtcatgaagccaggttataattagcttttgagaacaattacatatttgtgagagttgaacatttttttactctttttagtctgaatctaatgctctggtgactcatagaccagtgtagaagagcaaatcagatggctttggacacttttaagacaaaagtatgntttg

SEQ ID NO: 54413 - DNA, 100 bp, Homo sapiens
  misc_feature 5, 7, 67, 72, 77, 85, 93, 96, 97: n = A,T,C or G
attcncntaatggtttcttgtaaacatttttaagacagttgggatgtcacttaacattttttttttngagcnaaagncagggaancaagccangcnnaat

SEQ ID NO: 54414 - DNA, 398 bp, Homo sapiens
  misc_feature 1, 328, 355: n = A,T,C or G
ncgggggatgccgctcatagaatattatacaatatatgttctacatagtatttatagaacaataatgacaattactaaattgtattaggtatccagtacttgctgatttgtgtccatatcagcaataacaacgatattttgttagaagcagagacttcctaatttggaagtatggggaatgctagggaaaactgatgcaggcataaaggcagcatctggagagaaaggaaacaacactttcaatactaattttataagcaggtagtgccaaggaatccaattaggatcaacaggtacatgtgacaggaatcaaggaaacagatccttncatctgacccatcccactggagatggngggtaaacttaattaggttgcttggcctctacttgtggatttc

SEQ ID NO: 54415 - DNA, 393 bp, Homo sapiens
  misc_feature 85, 352: n = A,T,C or G
aatcaccaatccctgcaaggaggacaatgaacttgtatttgcactgactttcccagctgtttcttactttgatcaagttgggggngggacccattgagctgcatcacatcattccaaagccaaaacacagcagcagaacaagaatattttcaatgcggtctctaaagcggaggagaaactgttgagggaacctagaagtaaaggacatctggcttgctgggctccatttaaactttgagtatagcagagacacgagcccttcgggacacatgcctgtcgcagtgacactccaacttcggaagagtggaagccctgattccaaattcaagcatgctttgagtagaaattaagnttgcctcttttgcacaggaagatggccaatctttcctaagc

SEQ ID NO: 54416 - DNA, 132 bp, Homo sapiens
  misc_feature 4, 11, 36, 57: n = A,T,C or G
agtngggcaantgtctctctgatgtgtgccttttgntcaacacagtaacccctgcantctgctctgctctaatacactacctggagaaagtcttttccttattttcaataaatgtcagacattattgaaaag

SEQ ID NO: 54417 - DNA, 152 bp, Homo sapiens
  misc_feature 2, 11, 12, 15, 16, 22, 24: n = A,T,C or G
tncgcctttannggnncgtaangngcgacatatctggtcaagttgagatttttaagaacttcatttttaatttgtaataaaagtttacaacttgattttttcaaaaaagtcaacaaactgcaagcacctgttaataaaggtcttaaataatt

SEQ ID NO: 54418 - DNA, 374 bp, Homo sapiens
  misc_feature 14, 33, 54, 55, 330, 357: n = A,T,C or G
gagggctgcacatngcctgttctgcttcgaagnattcaatacccgctcagtatnntaaatgaagagatgctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgtatttatcaattttnccagtatttttatacggaaaaaattgnattgaaaccttagatgc

SEQ ID NO: 54419 - DNA, 122 bp, Homo sapiens
  misc_feature 2, 7, 27, 29, 37, 43, 52, 85, 86, 95: n = A,T,C or G
anattanataaggtagggagagtgatngnatttcgangaacgnaccaatcgngacagtatgtgaaaccaccatttcccctctgannagtaatgcnatttttatagaatattaaattcttatg

SEQ ID NO: 54420 - DNA, 397 bp, Homo sapiens
  misc_feature 9, 54: n = A,T,C or G
cggggattncagctctcagcaaaatagacatacaagggacataccttaatgtantaaaagccatctatacaaacccacagccaacataatactgaatgggggaacggtgaaagcattccctttgagaactggaacaagacgaggagcccactctcaccactcttcttcaacatagtactggaagtcctagccagagcaatcagacaaaagaaggaaatagaggaaatccaaatcggtaaagaggaagtcaaactgtcacttgttgctgatgatataatcttttgtttagaaaaccctacggactcctctagaaacctcctagaactgataaaagaattcagcaaagtttccggatacaagattaatggacacaaatcagtagctcttccatacatca

SEQ ID NO: 54421 - DNA, 400 bp, Homo sapiens
  misc_feature 7, 9, 27, 39, 52, 83, 84, 98, 102, 106, 109, 215, 245, 275,364: n = A,T,C or G
gaacccntntaaactaaatttaggttngcagaaagtatnaatcatttttaanctgaatgttgagacagtgcatccattttctnnagttgaatatgttngtantaantgnaaagccaagcttatcagttgactctctccagaataaataatcatctgtgtggcatacgttattggctttgtctgtaatactgccactaagtgattataattaagcngcctgtttgcatcaaatgtaaagactgtgntcacaaccgtagtaaaatttgggtttcatnggaaatgaaacaaattctaaagatgctttttcactagccctttgattttgctatatcataacctcttgggtcatatgctgagaaatttnagaaaggccatttttggttaaaaattagaccttttc

SEQ ID NO: 54422 - DNA, 361 bp, Homo sapiens
  misc_feature 5, 6, 359: n = A,T,C or G
gaagnnagagtaggaatcattcacatggataaaggagagaagggcatcctaggtagaacatatgctgaagcacaaaagaacctagaatacttacataacagatcaggatgtctagagtttgtgtggagtttatgaaggaggttaggggagatgagactgtaaaggaataatggagctgctgaaagatcattttttagccataaaaaagaaattgggccaggcacagtggctcagcctgtaatcccagcactttgggatgccaaggcaggtggatcacttgaggtcaggggtttgagaccagcctgtccaacatggtgaaccccgtctctactaaaaatacaagaattagccaggtgtgngg

SEQ ID NO: 54423 - DNA, 400 bp, Homo sapiens
  misc_feature 4, 12, 64, 88, 333: n = A,T,C or G
cggngcatcccngttttcttatttataggatgaggaaattagattaaatggttttgaggtcctntcttgttctgatatgtccagtacncactggaaaattggatctataactgatgggtttagtaatctgttcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcantagaattaaaggggcctggactcaggacctgcaggctattctttatccacatgtctctggaagggct

SEQ ID NO: 54424 - DNA, 220 bp, Homo sapiens
  misc_feature 10, 15: n = A,T,C or G
acaactaacnacgtnctctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattg

SEQ ID NO: 54425 - DNA, 400 bp, Homo sapiens
  misc_feature 2, 8, 31, 35, 37, 128, 312: n = A,T,C or G
anattctntgaatcctagcccatctgcagancaangnctgcgctcaccaggaaaagataacctttctttctgaaatagtcaaatacgaaattagaaaagccctccctattttaactacctcaactggncagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgnaaaggtgctcctcttttttcttggcattgctggcaagaatactaatatttgggaaggctttaaagacgcatggtatgggctaatggac

SEQ ID NO: 54426 - DNA, 333 bp, Homo sapiens
  misc_feature 41: n = A,T,C or G
gcccatagctgcttccttccagctgcctctggaacctaggnttagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggtctaagtgcaatgagttgtgttgaagcctccgtctccatccttgcctgtagcccgtagtcacttgtgcagtgaggacatctttttaaattt

SEQ ID NO: 54427 - DNA, 397 bp, Homo sapiens
  misc_feature 2, 38, 40, 41: n = A,T,C or G
gnattcaaggagtctatggtaaaggacaaaaggaaagntnnaaaatcatcacctagtaaggaaaatgagtcgagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggcttcctgcgggt

SEQ ID NO: 54428 - DNA, 383 bp, Homo sapiens
  misc_feature 5, 8, 28, 30, 60, 61, 155, 165, 177, 292, 327, 337, 350: n = A,T,C or G
aagcnccngtaaatacattttgtgcatntntccatattgaaatatttttgaagagtatannctatgaaacgactctgtggtcaaatgatatatcttttggagattaacaatacacttataagcatgttaaagactaggtaaagtcctagagtgcnagaaatagcntgctcactttgnttagtccagcatttcccaaacttagacactgagtgctttttttagtggagcatgtattaactttctgtggaagcacactttggaacacattgcatatgtgtagcagttttctttntcaaaaaaggccacctctatttggtgccatatctncctttaattnaaaaatttggggngccactctctcccctttttgcggagcttttggc

SEQ ID NO: 54429 - DNA, 145 bp, Homo sapiens
  misc_feature 4: n = A,T,C or G
ccgnggaatgcctcagagcaggtgttgatggctcctcctgtaatcccaacactttgtgaggctgaggtaggaggatcgtttgagcacaggagttcaagatgaagcctgagcaacatagtgagaccctgtctctatgaaaaaagtt

SEQ ID NO: 54430 - DNA, 308 bp, Homo sapiens
  misc_feature 8, 9, 52, 53, 238, 240, 263, 306, 307: n = A,T,C or G
gagacccnngctgcctctttcacatcaaagaactactgacaacgaaggccgnncctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttngncaaatgattttaattattggaangcacaatttttttaatatgcaaataaaaagtttaaaaacttanna

SEQ ID NO: 54431 - DNA, 214 bp, Homo sapiens
  misc_feature 11, 26, 28, 47, 49: n = A,T,C or G
taaattcagtncatccaaaatggagnantatccttcaccctcagtgngnaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttat

SEQ ID NO: 54432 - DNA, 175 bp, Homo sapiens
  misc_feature 14, 26, 39, 41, 49, 53, 76, 142: n = A,T,C or G
caggaggtgaactnccaggagtatgncaccttcctgggngncttggctntganctacaatgaagccctcaagggcngaaaataaatagggaagatggagacaccctctgggggtcctctctgagtcaaattcagtggtgggnaattgtacaataaattttttttggtcaaattta

SEQ ID NO: 54433 - DNA, 157 bp, Homo sapiens
  misc_feature 6, 7, 30, 42, 54, 89: n = A,T,C or G
actagnnaggcccagctactctggagcccngtagacccagcnacttgagaggcngaggcaggaaaatcgcttgaacctgggaggcggcnggctgcagtgagccgagatcgcgccactgcactccagcctgggcgacagaatgagactctgtctccga

SEQ ID NO: 54434 - DNA, 400 bp, Homo sapiens
  misc_feature 16, 24, 33, 48, 167, 250, 260, 301, 383: n = A,T,C or G
gagggaaggaggggcntctccttngtgaggaangactcatgacttctntaacgacaaacttaaccctaagggctactgctgagactgaaaaatcagctttctatttacatgaaacactttgggggtcatgggagtgcacagcattaagacagtatttggttcacccngtaaagtagccaagaaaagatgagaaaaatcaagataggcctggcacactagacatttgcctccaaaagaaataacctacagncttaagatgnatcataaaaatgttctgccaaggatctaaattaccttgggnttcgcatatgctatgaaattctgggataatttttttcaatacattgattcactggcgctgggtttcattttatacctttaanaacccatcactggggga

SEQ ID NO: 54435 - DNA, 394 bp, Homo sapiens
  misc_feature 1, 12, 90, 149, 215, 243, 288, 320, 332: n = A,T,C or G
ncggggagaccnaagcaaaacagaattttgatatttgctaaaaaagaaaaggccttgaaattagtgggctggttgaaaggggactggaantgcaagctgctcccatctgccattccagcttttaaggcttcttaattgaattggaagcncagttgaaaaaagaaaaggatcatctattctttcctctgttttcagataaagcctaagaacttttntgagggcaatttatacccattaaaatgncaaattcacatatcctttgcccaataatctcatttctagacatgnttgccacagaaaactcaaaacaagtatacagnacaaattagtgnacaggcagtttattgctacactattgcctaatgagacttgaagagagcatgctatcattaat

SEQ ID NO: 54436 - DNA, 142 bp, Homo sapiens
  misc_feature 1, 5, 31, 47, 53, 56: n = A,T,C or G
ngaangacccccgacccacgaatcggccggncgcgcgtgcaccatgnctgttnctncagcgtcgccgctatgaagaaagtgggcaacagctccggctggaggccggactcaaccgcgtaaaagtttcccaggcagctgcaga

SEQ ID NO: 54437 - DNA, 320 bp, Homo sapiens
  misc_feature 24, 211, 214, 225, 243, 294, 309: n = A,T,C or G
agatgtctcgctccgtggccttanctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggngcnttcagacttgnctttcagcccggactggnctttctatctcttggctacactgaattcaccccccctgaacaagatgagtntgcctgccgtgtganccatgtgactt

SEQ ID NO: 54438 - DNA, 150 bp, Homo sapiens
  misc_feature 132, 133: n = A,T,C or G
tgtgcgctgtgacattcgctacacaggacatcatgcgtatgccctcaggctgcacaatttcaccgtattagaaggcaaagcaaaactcccaatggataaatcagtgcctggtgttctgaagtgggaaaaaannagactaacttcagtagg

SEQ ID NO: 54439 - DNA, 240 bp, Homo sapiens
  misc_feature 1, 7, 12, 23, 26, 28, 31, 32, 33, 49, 50, 53, 56, 69, 104,127, 133, 141, 192, 221: n = A,T,C or G
ntctgtntggcnccggggccccnttngnttnnnaaggcgcgaaaaaccnnganagnggcagcgaggggnttttttagaggtgctcggattctcagtagccgggncgggacttaaccaccaccatgtngagctnatgaacanagaccaagaccaagaagcgccctcggcgtgcgccctccaatgtgtttgctntgtttgaccagtccagattcgggggttcnttgaggccttcaacatgat

SEQ ID NO: 54440 - DNA, 210 bp, Homo sapiens
  misc_feature 27, 144, 186: n = A,T,C or G
ctttagcacacttttgtatgttcttantattggaagataattttgtgaatctgtagattttattttttcagtcttaccttacaaatttcttttctatgaataatagaggaacttacggcactctgccatttgttaatgaaaggnagtgcagaggatttagaaaagtacatgatccccagaccacancaaaccaaaacataaactcatgtc

SEQ ID NO: 54441 - DNA, 110 bp, Homo sapiens
  misc_feature 4: n = A,T,C or G
attnctccaagcacttgagccgtgctttaggtatagatggactggctttggggccatcctagtaatcaacatggttaatggcagcttctctctctgtccttgagtctttt

SEQ ID NO: 54442 - DNA, 370 bp, Homo sapiens
  misc_feature 18, 26, 175: n = A,T,C or G
ctaaattgaataacgagnaaataatnttacttgggtagagatggcctttgccaacaaagtgaactgttttggttgttttaaactcatgaagtatgggttcagtggaaatgtttggaactctgaaggatttagacaaggttttgaaaaggataatcatgggttacgaaggaagtgnttgaaagtcactttgaaagttagttttgggccacgcacggtagctcacccttgtaatcccagcactttgggaggctgaggtgggtagattacttgagcccaggaattcaagaccagcctgggcaacatggtgaaaccctgtttctataaaaaataatctgggctttgtagcatatgccctgtggtccccagctac

SEQ ID NO: 54443 - DNA, 129 bp, Homo sapiens
  misc_feature 3: n = A,T,C or G
cgnagcattcaggcatggattccgtgaaggaacaacacctaaacccaagagggcagctgttgcagcatccagttcatcttaagaatgtcaacgattagtcatgcaataaatgttctggttttaaaaact

SEQ ID NO: 54444 - DNA, 200 bp, Homo sapiens
  misc_feature 22, 24, 77, 103, 119, 120, 121, 187: n = A,T,C or G
gtgtctccccacatctctgacncngaaccacacatgcatggagcctactcaaagcaacctagctatggacagaaganctcactaagaccagacttgtagcccnggaaacagcctgcagnnngggcgcggacaagagaactatctgctaaaacaaaggaagcaacactcattggagaaaaaacagaanccagaatcttcac

SEQ ID NO: 54445 - DNA, 410 bp, Homo sapiens
  misc_feature 111, 256, 352: n = A,T,C or G
tctgagtgcattcagaacaagcccctgtattttgctgatcggctgtatgactccatgaagggcaaggggacgcgagataaggtcctgatcagaatcatggtctcccgcagngaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggnctgagcgtccagaaatggtgctcaccatgcttccagctaacaggtctagaaaaccagcttgcgaataacagtccccgtggccatccctgtgagggngacgttagcattacccccaacctcattttagttgcctaagcattgcctggccttcctg

SEQ ID NO: 54446 - DNA, 400 bp, Homo sapiens
  misc_feature 330, 335: n = A,T,C or G
gagacatatttctcttattcccagaaacgggcaaaagaaatattgctgaactctttccctagtaaggaatattaataattaacagccctgggaaaagaatgcattcccagagggaggcccctaaaatggccgctctgggagtgtctgccttatgcagttgtagatagggatgaaacacaacctggtctcctgcagcgcccccaggcttgctaggattaggaaaatccagcctggagaattctagtcagactgtttctctgctcttgaaccctgtttcctgttaagatgtttatcaatgacaatgtgtgcccagtgggacatgaaacttcntcagnaattctagttttgccctgaccttgtgacctcgccctgcccatttgccttgtgatattttattgcc

SEQ ID NO: 54447 - DNA, 200 bp, Homo sapiens
  misc_feature 97, 110, 136, 147, 161, 166: n = A,T,C or G
aaaaacaaaacacttaactagaattctctaataaggggtatgggttagcttaaagagcacctttggatttttattatcagatggggcaacatattgnatgaagcatatgnagcacttcacagcatggggaggaggnaagctgcaggnagaagcaaagctgnaaagnagatttatcacacaatgactgcatacagacttca

SEQ ID NO: 54448 - DNA, 380 bp, Homo sapiens
  misc_feature 143, 149, 217: n = A,T,C or G
gtgctcgcgctactctctctttctggcctggaggctatccagcgtactccaaagattcaggtttactcacgtcatccagcagagaatggaaagtcaaatttcctgaattgctatgtgtctgggtttcatccatccgacattgnaggtgncttactgaagaatggagagagaattgaaaaagtggagcattcagacttgtctttcagcaaggactggnctttctatctcttgtactacactgaattcacccccactgaaaaagatgagtatgcctgccgtgtgaaccatgtgactttgtcacagccccaagatagttaagtgggatccgagacatgtaagcagcatcatgggaggtttgaagatgccgcatttggattgga

SEQ ID NO: 54449 - DNA, 170 bp, Homo sapiens
  misc_feature 28, 36, 38, 149: n = A,T,C or G
aacaaccgacactcctacatggatttanaaaaaagntnacgacataatctagtttacatgaaaaatcttgtgctaggaatactttttaaaaggtattttgaataccattaaaactgcttttttttttccagcaagtatccaaccaactnggttctgcttcaataaatctt

SEQ ID NO: 54450 - DNA, 100 bp, Homo sapiens
tgagtatttcaagcgttttaatgcattgcagtatctgcgtttatctcacaacgaactggctgatagtggaatacctggaaattctttcaatgtgtcatcc

SEQ ID NO: 54451 - DNA, 227 bp, Homo sapiens
gagcacgaccgcctgagttcaggagttcaagaccaccctgaccaacatggagaaaccccatctctactaaaaatacaaaaaattagccaggcatggtggtgcatgcttgtaatcccaggtactcgggaggctgaggaggcggaggttgcagtgagctgagatcacaccactgcactcccagcctgggcgacagagtgagacttcttctcaaaggaaaaaaaaaaaaa

SEQ ID NO: 54452 - DNA, 132 bp, Homo sapiens
  misc_feature 22, 48: n = A,T,C or G
ggtacgggcaaggcgaagaaanaccaatgggagcaaggatagggaaantagaagataataaacatacttttagaagaaaaaaggataaatttaaacctgaaaagtaggaagcagtaaaaaaaaaaaaaaaaa

SEQ ID NO: 54453 - DNA, 400 bp, Homo sapiens
  misc_feature 280: n = A,T,C or G
cgttgcagtcggccagcccccttctccacggtaaccatgtgcgaccgaaaggccgtgatcaaaaatgcggacatgtcggaagagatgcaacaggactcggtggagtgcgctacctcaggcgctggagaagggcaacatagagaaggacattgcggctcatatcaagaaggaatttgacaagaagtacaatcccacctggcattgcatcgtggggaggaacttcggtagttatgtgacacattgaaaccaaacacttcatctacttctacctgggccaagnggccattcttctgttcaaatctgggtaaaagcatggactgtgccacacacccagggatccatccaaaaacaagggactgcaggcctaaattccaaataccagagactgaaattttcagcc

SEQ ID NO: 54454 - DNA, 410 bp, Homo sapiens
  misc_feature 10, 31: n = A,T,C or G
aacctagtanatggacaggttatcaacgttnacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttccagcaagtatccaaccaacttggttctgcttcaataaatctttggaaaaactctttaaaaaaaaaaaaaaaaaaaaaaaaaa

SEQ ID NO: 54455 - DNA, 349 bp, Homo sapiens
  misc_feature 60, 287: n = A,T,C or G
ttttaagtaggaaagagacgccaacacacttctgctttcacttaagtgactggcccgcantactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgnatgtgccaaagctttactactgtggaaagacaactgttttaataaaagatttacattccaca

SEQ ID NO: 54456 - DNA, 116 bp, Homo sapiens
  misc_feature 31, 65, 96: n = A,T,C or G
cagctctttggacactaggaaaaaaccttgnggagagagtaaaaaatttaacacccatagtaggnctaaaagcagccaccaattaagaaagcgttnaagctcaacacccactacct

SEQ ID NO: 54457 - DNA, 220 bp, Homo sapiens
  misc_feature 42, 52, 67, 74, 75, 88, 99, 105, 106, 140, 148, 176, 194,214, 216: n = A,T,C or G
ctcataaaacatgaatcaagcaatccagcctcatgggaaggnctggcacagnttttgtaaagccctngcacagnnggagaaatggcancattataagcnatgagnngaaatgttctgtcaaatggggctcacatctacangggggggnggaggcttttatggggccctggccaggnagaaaagaaatgggatgnagagcttagatttccctatngngaca

SEQ ID NO: 54458 - DNA, 400 bp, Homo sapiens
tgctgagggggcaggcggagcttgaggaaaccgcagataagtttttttctctttgaaggatagagattaatacaactacttaaaaaatatagtcaataggttactaagatattgcttagcgttaagtttttaacgtaattttaatagcttaagattttaagagaaagtatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaata

SEQ ID NO: 54459 - DNA, 320 bp, Homo sapiens
  misc_feature 16, 32, 91, 189: n = A,T,C or G
gtcgcagcttttctgngcgcggagttgagtanccctgtggcccttaggtctcgggacacgctgtagtcgctgaggctgcagctatcatggngaacttacttcagattgtgcgggaccactgggttcatgttcttgtccctatgggatttgtcattggatgttatttagacagaaagagtgatgaacggntaactgccttccggaacaagagtatgttatttaaaagggaattgcaaccccagtgaagaagttacctggaagtaaagactggctagattatcgaatgttcacattttaaagttctgagagaaataaaaaca

SEQ ID NO: 54460 - DNA, 510 bp, Homo sapiens
  misc_feature 18, 23, 320, 493: n = A,T,C or G
atctgtcctataacaagncttantttcataccaactgtcaatgaaaacctctgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgnttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtggttttttatttctactgncaaatgatgtacaaaac

SEQ ID NO: 54461 - DNA, 440 bp, Homo sapiens
  misc_feature 25, 26, 390, 413: n = A,T,C or G
ttttaagaattcaaaactagtgtanntcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatcaataaatataaaatataagcacatatttattatatatctaaggnatacaaatctgtctacatgaagnttacagattggtaaatatcacctgctc

SEQ ID NO: 54462 - DNA, 220 bp, Homo sapiens
  misc_feature 14, 218: n = A,T,C or G
gtgtaagaccctgntctttctgtaatgtttcattttttaaatctgacaaactaaaaaggttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggntg

SEQ ID NO: 54463 - DNA, 220 bp, Homo sapiens
  misc_feature 34, 38, 108, 122, 133, 151, 152, 160: n = A,T,C or G
agcgccaaggtaggctggtgtcattagtcttctnactnctaatccatgaccactgtttttttcctatttatatcaccaggtagcctactgagttaatatttaagttgncaatagataagtgnccctgttttgnggcataatataactgggnntcatgagnaagatttattccaccaggggtatttcagctttgaaaccaaatctgtgtatctaatactaa

SEQ ID NO: 54464 - DNA, 150 bp, Homo sapiens
  misc_feature 12, 24, 28, 93, 94, 106, 145, 147: n = A,T,C or G
ggcttttgctanccaagggacccngggnctctggcaagcatggggtgcttttccgaatgccaagaccgaggtgccttacgaaggcagctgccnntggttctgtggnacagactggctcctgagaacccagacgaccttgacctgncngcc

SEQ ID NO: 54465 - DNA, 420 bp, Homo sapiens
  misc_feature 14: n = A,T,C or G
gcttgtgaaaaatngggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattattttgttactttttgatttgagaactctacaaataaaagtgctgggactagattaattgcaaacattttagttatatgtgtagagctttattggtactcctttttagctacccct

SEQ ID NO: 54466 - DNA, 410 bp, Homo sapiens
ttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgctttttagattaaaatgaaggtgacttaaacagcttaaagtttagtttaaaagtt

SEQ ID NO: 54467 - DNA, 400 bp, Homo sapiens
  misc_feature 19, 24, 26, 317, 368: n = A,T,C or G
taactattttgaattatgnaaagnangcccaattgaaaaaattattcaacaagtaaaagctaagaaatttcattgaaatcataaagcagtttaagcataaattgataaaaatagctgtgtactactaattaatagaaaatcattcaaccaagagaagagtcaagtgaatatcgtttggttatttgctagtgagtttctttgtaacgttgattttattaaatgataatatttggttagtatgtcctatgttaataaaaatgaacaaaattaattttgctatgttcaggtgtcttgataaaataacaatgctccagtgntgttgcttacatttagcactaaattttaacacagcgtcagtgagtccaggntttaacttcttcatgcctggatgggataaaat

SEQ ID NO: 54468 - DNA, 100 bp, Homo sapiens
  misc_feature 87: n = A,T,C or G
aaggaggagatcatcaagactttattccaaggaggaagagaccaagaaataaaacctcccactttgtctgtacatactggcctctgngattacatagatc

SEQ ID NO: 54469 - DNA, 240 bp, Homo sapiens
  misc_feature 85, 174, 202: n = A,T,C or G
tcactgcaaaaatagcattgcatacatggatcaggccagtggaaatgtaaagaaggccctgaagctgatggggtcaaatgaaggngaattcaaggctgaaggaaatagcaaattcacctacacagttctggaggatgggtgcacgaaacacactggggaatggagcaaaacagnctttgaatatcgaacacgccaaggctgngagactacctattgtaggatattgcaccctatgacatt

SEQ ID NO: 54470 - DNA, 110 bp, Homo sapiens
  misc_feature 3, 45, 87, 88, 89, 100: n = A,T,C or G
ctngaatgggcacaaacagggttcccagcccaatagttcgggatnggggggtaaggttctacatgggaaaggatccagtctcttgcnnnacctcaggggnctgggaccac

SEQ ID NO: 54471 - DNA, 200 bp, Homo sapiens
  misc_feature 47, 102, 118, 124, 165: n = A,T,C or G
tataatgaaaatttgggtaaagaaggagtttcagcagcttttgctgngaagctctttaaatcatggataaatgaaaaagatatcaatgcagtagctgcaagncttcggaaagtcaggngggggnacagactgatggaactctttcctgccaataagcaaaggggngaacacttcacaaaatatttttactgaggcagggt

SEQ ID NO: 54472 - DNA, 314 bp, Homo sapiens
  misc_feature 310: n = A,T,C or G
ttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccggacactttcatactaagactgtaagtagatctcagttctgcgtttattgtaagttgataaaaacatctggaagaaaatgactaaaactgtttgcatctttgtatgtatttattacttgatgtaataaagcttattttcattaacaaaaaaaaanaaaa

SEQ ID NO: 54473 - DNA, 247 bp, Homo sapiens
  misc_feature 22, 23, 33: n = A,T,C or G
gaaacataaacataaggaggcnngagacatganatgcagccggctctgaccccaaagagccatgggacctgaccacctgggaggagctggaggacaaaggacttcacagaagaatggagtcccaaagaaacagcttcaggaactgaggagagccagaaatttaatgtatttagggctcccttgtgaaaacacaaaaacaaaaataaaaatgcctcccgctgcctcgaaaaaaaaaaaaaaaaaaaaa

SEQ ID NO: 54474 - DNA, 300 bp, Homo sapiens
  misc_feature 10, 13, 145, 146: n = A,T,C or G
atttttaggnctntcgtggtcatgtaaattccgggaaattcaacaggagctttccagtggaaggaatgaaggccagctgaatggtgaaacaaatacacccattgaaggaaaccaggcgggtgatgcagctgcctctgccaggagnntaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaa

SEQ ID NO: 54475 - DNA, 260 bp, Homo sapiens
gctggcacctggcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggat

SEQ ID NO: 54476 - DNA, 244 bp, Homo sapiens
  misc_feature 129, 132: n = A,T,C or G
acctagtaatgatttgtacacactcgtggtcaactgaacatgaatgtcagtagtagtctaattatgggaagggtaaacgtgttagattaaggctcttaaagctctaaaccatataaactatggacttgnatnatgatttaactgttcttagatctttcttacacagtgattcattcctctatttgtacagtggctttatgaaatgttgtgaattgatactgtaatcaataaagtgcttttaacc

SEQ ID NO: 54477 - DNA, 420 bp, Homo sapiens
agcgggtagcgtgaggaaagccgtgctttgcgttccaaggcatctgtgagcccgcggcagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaat

SEQ ID NO: 54478 - DNA, 330 bp, Homo sapiens
  misc_feature 25, 146, 148, 149, 220: n = A,T,C or G
ctaatctggattcactccctctggntgatacccactcaaaaaggacacttctgattaagacggttgaaactagagatggacaggttatcaacgaaacttctcagcatcacgatgaccttgaataaaaattgcacacactcagtgcngnnatatattaccagcaagaataaaaaagaaatccatatcttaaagaaacagctttcaagtgcctttctgcagnttttcaggagcgcaagatagatttggaataggaataagctctagttcttaacaaccgacactcctacaagatttagaaaaaagtttacaacataatctagtttacagaaa

SEQ ID NO: 54479 - DNA, 420 bp, Homo sapiens
  misc_feature 26: n = A,T,C or G
cactctttccgtacatccattatttncatgctaatgtgtgtctgggatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacacctgcactatgaggtaccttggtgtcctggtgtgaatagacaagaagctgtactatatgttgctctctcagtggcaacaatgaagtttttgcaattctagaacttggatttttttttaacaaaagt

SEQ ID NO: 54480 - DNA, 230 bp, Homo sapiens
  misc_feature 23, 42, 55: n = A,T,C or G
tttatagaattgaagttaacatncgtattttcaagagaattnatggacgttgtanaaatgtacaaatgcatttccaaactgccttaaacgttgtatttttatagacatgttttttaaaaatcctaagtttttaaataactatggatttgtgtattttttttggttatttgttttattaaaacatgtacatcagtaaagaggtttaaaaaaaaaaaaaaaaaaaaaaaaaa

SEQ ID NO: 54481 - DNA, 230 bp, Homo sapiens
  misc_feature 58, 77, 100, 149, 171, 182: n = A,T,C or G
gggttgcatgtttaaagttaaagtgacttttaaaggccacatcacctgagactagggnaatcatctttacttctggntcctgaaatcatatttttccagnggaccatcctccagtggctgtggttgttgagcatgcctttcagaaacancctatgtggcttaaaacttagnttatgttttgngttcaacactacgtgtaatattttaaaactgtttaatgggatgtgaat

SEQ ID NO: 54482 - DNA, 280 bp, Homo sapiens
  misc_feature 190, 223, 257: n = A,T,C or G
aagagttctgaaatagtgaagagttcctatacatagaatgtgatacctctgtcattttaccaacttcctagaatgccagttgaaattaggtaattttagagaaaaaccaccctgatttttgttttaattttaaatttcagagctccagagattatattggggttgccattttgtgaagccatagacatgnggtcattgggatgtgtgattgcaagaattattncttggatgaccgctctacccaggagccttggagngtgatcaggtaacaaataatgat

SEQ ID NO: 54483 - DNA, 320 bp, Homo sapiens
  misc_feature 148, 150: n = A,T,C or G
aggtggatcatgagcaaaatcctgggggctctttgttggaggaaactaaacattcccttgatggtctcaagctatgatcagaagactttaattatatattttcatcctataagcttaaataggaaagtttcttcaacaggattacagngnagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaat

SEQ ID NO: 54484 - DNA, 400 bp, Homo sapiens
  misc_feature 20, 27, 184, 298, 371: n = A,T,C or G
caatagtctttgaatatcgnacacgcnggtgtgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgntctaatcttgtcaaccagtgcaagtgaccgacaaaattccagttatttatttccaaaatgtttggaaacagtataatttgacaaagaaaaatgatacttctctttttttgctgntccaccaaatacaattcaaatgctttttgttttattttttttaccaattccaatttcaaaatgtctcaatggngctataataaataaacttcaacactcttt

SEQ ID NO: 54485 - DNA, 203 bp, Homo sapiens
aggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccgcaaaaaaaaaaaaaaaaaaaaaaaaaa

SEQ ID NO: 54486 - DNA, 357 bp, Homo sapiens
  misc_feature 38, 211: n = A,T,C or G
tagaacggatacccagattttacagatgcataggacancatcaaacattagtaagtctaaataagatgaatagaatttttgttatgtaaattttgctagaacagtctattttcttgcacccctcaagttaacctcttaaaaaatgaatgtataatttctaccgaaagaatatcagagagaatctctctggcctatagtgttaaaatattgntcacaaatcctgattagttaagtgcatacattatgaaacttacagaataaaacttattatacatctctttcttaaattaatatctttacacattttcaactggctccccaagtctgataaggaaggattaaaagaaaaaaaaaaaa

SEQ ID NO: 54487 - DNA, 510 bp, Homo sapiens
  misc_feature 24, 48: n = A,T,C or G
taaaatggattttttcttcttgtnttgtttagtctcttccttttattnaggctgcagcttttaaagctacattttatttagttgtagtattaatttatagctgaagctccaaaaatgttttatttttcttttatcatggtaaaattaatcctttaattttattctcccttgtcattgatcatttctagcataagattaaaattatatacttcattaattttcctcacactgcaaaatttagttttacagtatggtatgaaccctgttgttttgagtgttgttatacttcttgtgctttaaacttttgtcatttgatagaaatggtacatttcgaagggtacatgtaaatggtatatttttaattttgttttctttttagcactcaaggagattctgacagaaaatggtatattttatgagtaagtgattttgtgaaaagcatttcagagcttccatttcccctcttgctttgataaataccttttacttcagataacatggtagttttgg

SEQ ID NO: 54488 - DNA, 440 bp, Homo sapiens
acccaaggtaaagaagaaaaagggcctgaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatggggagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattc

SEQ ID NO: 54489 - DNA, 370 bp, Homo sapiens
  misc_feature 20: n = A,T,C or G
gtgggctgatggctgagagngtgtgtgactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtag

SEQ ID NO: 54490 - DNA, 410 bp, Homo sapiens
  misc_feature 13, 19: n = A,T,C or G
accagcacgctgntgctgntgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggag

SEQ ID NO: 54491 - DNA, 291 bp, Homo sapiens
ctaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaaaaaaaaaa

SEQ ID NO: 54492 - DNA, 540 bp, Homo sapiens
  misc_feature 27, 29, 33: n = A,T,C or G
caagcgtgaggggagtagggctgtgcnantcanatactgtttttctcccgaaataggaaattggcttatttttttctcctcggcagcatcttaatttaaaatatgacacttgacctacggccctgcacggagcggttaagagggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcaccttgaatctggatcaaccttgaaaaaattcctggaggaatctgtgtcaatgagccctgaagaacgagccagatacctggagaactatgatgccatccgagtta

SEQ ID NO: 54493 - DNA, 354 bp, Homo sapiens
  misc_feature 17: n = A,T,C or G
actaaccctataccatncgtaagaacaattctttctggacgcaataacattagtttccatagtttttcatgtacaatggctaccacttagtcaaactaagtagacactacaggcatcaggattaaatggctaaaagttaagatgaaaaaccagaaagacatacatataatgcagatactgaagacagacaagactttcaagtaattataattaaaatgtttaagaaaataggtaacaagaattttgccagaaactgtatctttaaaaaaatggaaattctaaattgaaaaaaatgtaataaaatgaagtcctgaaaaagtggatttaactgcagaatggaagattagtgaactg

SEQ ID NO: 54494 - DNA, 400 bp, Homo sapiens
  misc_feature 87, 114, 115, 189: n = A,T,C or G
cctaacaccgaacaccatgccttcaattaagttgcagagttctgatggagagatatttgaagttgatgtggaaattgccaaacaatntgtgactattaagaccatgttggaagnnttgggaatggatgatgaaggagatgatgacccagttcctctaccaaatgtgaatgcagcaatattaaaaaaggncattcagtggtgcacccaccacaaggatgaccctcctcctcctgaagatgatgagaacaaagaaaagcgaacagatgatatccctgtttgggaccaagaattcctgaaagttgaccaaggaacgctttttgaactcattctggctgcaaactacttagacatcaaagggttgcttgatgttacatgcaagactgttgccaatatgatcaag

SEQ ID NO: 54495 - DNA, 400 bp, Homo sapiens
  misc_feature 143, 249, 271: n = A,T,C or G
tggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgngagagagctgaaaccagctcgaatatatggattgggatctttagctctgtatgaaaaagctgatatcaaggggcctgaagacaagaagaaacacctccttattggngtgtcctcagatcgaggactgnggggggctattcattcctccattgctaaacagatgaaaagcgagggtgctacactaacagcagctgggaaagaagttatgcttgttggaattggggacaaaatcagaggcatactttataggactcatt

SEQ ID NO: 54496 - DNA, 134 bp, Homo sapiens
  misc_feature 13, 15, 40: n = A,T,C or G
taatttagttatntnacattaggttttgagtaactattcnggatatctgcataaccagctgcctcatgcctgtttccccatgctacccttttccttcccagcaaatggtaaaaaaaaaaaaaaaaaaaaaaaaa

SEQ ID NO: 54497 - DNA, 200 bp, Homo sapiens
  misc_feature 49: n = A,T,C or G
ggagaaaatgctcgaggtatgacactttttcttcttgcatgcatgtcangctacataaacagttttgtacaatgaaaattactaatttgtttgacattccatgttaaactacggtcatgttcagcttcattgcatgtaatgtaggcctagtccatcagatcatgtgttctggagagtgttctttattcaataaagtttta

SEQ ID NO: 54498 - DNA, 413 bp, Homo sapiens
  misc_feature 17, 47, 54, 55, 65, 199: n = A,T,C or G
gaaagtgattgcagctnttggttaatatgtctttttttttcttgttnccagggnnctatttgctntaatgagaatagaaacgtaaactatgacctaggggtttctgttggataattagcagtttagaatggaggaagaacaacaaagacatgctttccatttttttctttacttatctctcaaaacaatattactttgncttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcccttgtatctttctttctctaacaaaaaaaaaaaaaaa

SEQ ID NO: 54499 - DNA, 350 bp, Homo sapiens
  misc_feature 53: n = A,T,C or G
ctgggacccatgaacattccttttggtatcagacccgaagcgcaccattgctnaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcag

SEQ ID NO: 54500 - DNA, 230 bp, Homo sapiens
attgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaaaaaaaaaaaaaaaaaaa

SEQ ID NO: 54501 - DNA, 490 bp, Homo sapiens
  misc_feature 19, 24, 31, 40, 42, 55, 57, 65: n = A,T,C or G
ggcgcagataggatatagnaccgnaagggtnaaggatgananattataaccaagncntactgtancgaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaaaaaaaaaaaaaaaaaaaa

SEQ ID NO: 54502 - DNA, 310 bp, Homo sapiens
  misc_feature 12: n = A,T,C or G
ggggaagggtgntgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggtctcctgagaactt

SEQ ID NO: 54503 - DNA, 400 bp, Homo sapiens
  misc_feature 25, 40, 42: n = A,T,C or G
cttgtaaatttagtagtagttcgtnatgttctactgccgnangatgtggcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatg

SEQ ID NO: 54504 - DNA, 128 bp, Homo sapiens
  misc_feature 18: n = A,T,C or G
acagaccctggggaatcncttgaacctgggaagcggaggttgtatgtgagctgagatcacaccactgcactccagcctgggtgacagagcaagactctgtctcagaaaaaaaaaaaaaaaaaaaaaaa

SEQ ID NO: 54505 - DNA, 349 bp, Homo sapiens
  misc_feature 23, 43, 49: n = A,T,C or G
gtggtcctgatcaagcaatttgntgtggacgttggccctgatngctttntataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatggcaaaaaaaaaaaaaaaa

SEQ ID NO: 54506 - DNA, 199 bp, Homo sapiens
  misc_feature 40, 146: n = A,T,C or G
atgcctcggacaacagcagcctcatgtttcccatcctggnggccttcggagtcttcattccaaccctcttctgcctctgccggttgtgagaacaaatgactatcctgaacagggtggaggggtgtgggaaagaaaccagccatatngggtttggtttctgtatttttcacaaaaaaaaaaaaaaaaaaaaaaaaaaaaa

SEQ ID NO: 54507 - DNA, 140 bp, Homo sapiens
  misc_feature 120: n = A,T,C or G
atacctgaaagatggttaccgaatagcccagccaatcaactgtcctgatgaattatttgctgcgatggcctgttgctgggccttagatccagaggagaggcccaagtttcagcagcctgngacagtgcctaacagagttt

SEQ ID NO: 54508 - DNA, 370 bp, Homo sapiens
tagttgccatcagatttgattgtgaacaaggactgactgcagaaaataatggaaaggatgtttaactcttttatctccgaacattgaatgggataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggac

SEQ ID NO: 54509 - DNA, 230 bp, Homo sapiens
  misc_feature 78: n = A,T,C or G
cttctagctgagggggcaggcggagcttgaggaaaccgcagaataagtttttttctctttgaaagatagagattaatncaactacttaaaaaatatagtcaataggttactaagatattgcttagcgttaagtttttaacgtaattttaatagcttaagattttaagagaaaatatgaagacttagaagagttgcatgaggaaggaaaagataaaaggtttctaaaacat

SEQ ID NO: 54510 - DNA, 300 bp, Homo sapiens
  misc_feature 16, 25: n = A,T,C or G
cacttacactgttctngtagatggntgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgctta

SEQ ID NO: 54511 - DNA, 240 bp, Homo sapiens
  misc_feature 17, 132, 133, 154, 168: n = A,T,C or G
tatttcttctctgccgncacagaaagcagagtttctttcaaacttcactgaggcatcagttgctctttggcaatgtcccttaaccatgattattaactaagtttgtggcttgagtttacaaattctacttgnngcattgatgttcccatgtagnaagtcatttttagnttgggtgggaaaaaaccctggctgaagttggattttcagttaaaagaaaaaagaaactagtcccagatttga

SEQ ID NO: 54512 - DNA, 346 bp, Homo sapiens
  misc_feature 33: n = A,T,C or G
aagaatgaactttgtattatgatttcattatcncatgattatagaaggctgccttagtgcaaaaaacatacttacatttcagacatatccaaagggaatactcacattttgttaagaagttgaactatgactggagtaaaccatgtattcccttatcttttactttttttctgtggcatttatgtctcatgtaatttgcattactctggtgaattgttctagtactgtattgggcttcttcgttaatagattatttcatatactataattgtaaatattttgatacaaatgtttataactctagggatataaaaacagattctgaaaaaaaaaaaaaaaaaaaaaa

SEQ ID NO: 54513 - DNA, 300 bp, Homo sapiens
gcatcttgcctggatgagccaggggacacaggaagagaagcccactatctcatttaatctttacaactctcttgcaaggttccctggttgtgaaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccctcttcgag

SEQ ID NO: 54514 - DNA, 380 bp, Homo sapiens
  misc_feature 49, 54, 160: n = A,T,C or G
aagtaaattttatatgtgattaagttaaacttttgaattgatttgaggngcagnaaaatgaaagctatatctattctaaaccttatttagacattggtaccagttacccaggtgaaaatatggagtaactttgttttgtatggtaaggtttaggaatggnggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaa

SEQ ID NO: 54515 - DNA, 410 bp, Homo sapiens
  misc_feature 198, 344: n = A,T,C or G
ggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggngtccttcataatgaagttaaagtgagtatactgtggagaggacttccaaatgtggttacctcagctatatcactgcccaacatcagaaaacctgacggctatgattactatgccttttctaaagatcaatactataacattgatgngcctagtagaacagcaagagcaattactactcgttctgggcagacccttatccaaagtctgggaca

SEQ ID NO: 54516 - DNA, 187 bp, Homo sapiens
agaaatggcatcattataagctatgagttgaaatgttctgtcaaatgtgtctcacatctacacgtggcttggaggcttttatggggccctgtccaggtatgaaaagaaatggtatgtagagcttagatgtccctattgtgacagagccatggtgtgtttgtaataataaaaaaaaaaaaaaaaaaaa

SEQ ID NO: 54517 - DNA, 390 bp, Homo sapiens
  misc_feature 388: n = A,T,C or G
tgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagctttgaagccaccattaatgaattagnct

SEQ ID NO: 54518 - DNA, 340 bp, Homo sapiens
  misc_feature 3: n = A,T,C or G
atngaaaggaatacttaggaataggctgaagccaagaggcaaaaatcttgtacactgaaaaccataaaacgttgctgaaagaaatcaacaaagacacaaacaaatggaaatgcatcatgtttgtggattgcaaaacaatattgttaaaatatctaccctacccagatcaatcaatgaattcaacgcaatcactgtcaaaatcctaatggcatattttttgtagaaatagaaaaaaagaatcctaaaattcatatggaatctcaaaggacaatgatgaaatgatcttctacaaaggcaccaaggctatataagagagaaaagacagtctcttcagcgaatg

SEQ ID NO: 54519 - DNA, 320 bp, Homo sapiens
ctataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattggagaagatgcaggaataaagtaatcttatatacaagctttgattaaaacttgaaacaaaaaaaaaaaaaaaaaaaaaaaaa

SEQ ID NO: 54520 - DNA, 300 bp, Homo sapiens
  misc_feature 198, 221, 254, 266: n = A,T,C or G
gtttggttttttttctgagctactcggactctttattagaacaatcaatcattttcctttggacctacaatttttgcctatgctgcagccacctttgtgagtgagaatgaatatgtctgtgtgaacacacaggcatgcgtgtgtatgtgcacgtacatgggccagaatgaatggatgtgtgtgtgtgagggatacctnagatttttcttttcttattttgngtgaaaatctcttttctacagattttccagggnttaagcattgcnttgctgtataaaaaactttactgaattatataca

SEQ ID NO: 54521 - DNA, 400 bp, Homo sapiens
aagagtttggggcgcggactggagtaccttgcgtgcagttatgtcggcgtcggtagtgtctgtatttcgcggttcttagaagagtacttgagctccactccgcagcgtctgaagttgctggacgcgtacctgctgtatatactgctgaccggggcgctgaagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcacctttgttgtcatgaactttgttggctgacctcattctcatttactt

SEQ ID NO: 54522 - DNA, 380 bp, Homo sapiens
  misc_feature 9, 134: n = A,T,C or G
atacatgcntacaaagaggtgtacatggtaccatcttgtatacccatatatacccacatgtacagacatacatttatgcacattcacgctgttttgtttcatatatacaggcataaaatagagtaaatacaggnagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttttaagattaccttcttgttgataaaccataaatgaatcatcaaagctcacaccaaatttttctatcaaataaaactagtgacagcttgtggctttttattagagctcgccac

SEQ ID NO: 54523 - DNA, 200 bp, Homo sapiens
  misc_feature 42, 45, 97, 101, 117, 177: n = A,T,C or G
catcttggttccgcgttcccctgcacaaaatgcccggcgaancancagaaaaccgtcccctgctacagagcaggagttgccgccacccccaggctgnagancagggtctgggaacanaatctgacagtgatgaatcaggtaccagaagcttgaagaacaggattcccaccccaggcnaacccacacaaacaagccccagc

SEQ ID NO: 54524 - DNA, 180 bp, Homo sapiens
cttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaa

SEQ ID NO: 54525 - DNA, 290 bp, Homo sapiens
gctcctagagatattcttatttcactaaatgtaaaatttggagtaaatatatatgtaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaaaaaaaaaaaaaaaaaa

SEQ ID NO: 54526 - DNA, 227 bp, Homo sapiens
  misc_feature 170, 184, 188, 206: n = A,T,C or G
agccagtctctaggctactgctgtgcagtggctcccactttctaatgctttttttgtttttgctttttctaacaaaacaatcttttttcaaaatgaattccaacccctgctagcttccttccccgcctccatactgttttaggcagcaccgtttatgtgacagagtccgngtttctcaaatgcntggngttcctcaggtggagagngggcagaagtttttgcaacac

SEQ ID NO: 54527 - DNA, 280 bp, Homo sapiens
  misc_feature 45, 78, 187: n = A,T,C or G
gaattccgtgtagtggccaagctttgttccaaagaagggggaggnggtgacagtctcttgcccactgaagcgtgccanacagagtgctaggcatgggggcaggaggtgaatcagaatgacagccacctctcaccacgaggagtggctgaaagtgtgactggactacaggcaatcctggccttggcanggttttgcatagagtgagcatcacttggacaaatcctttggattaaaaaaagatctactaagtgagggggaagaaaaaaaaaaaaaaaaaaaa

SEQ ID NO: 54528 - DNA, 300 bp, Homo sapiens
  misc_feature 16, 80, 141: n = A,T,C or G
actgcgataggaatcntgtctggtcgcggcaaaggcggaaaaggcttggggaagggtggtgctaagcgccatcgtaaggngctccgggataacatccagggcattacaaaaccggctattcgccgtttggctcggcgcggnggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgcccctgaaacgtcaggg

SEQ ID NO: 54529 - DNA, 200 bp, Homo sapiens
gaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagt

SEQ ID NO: 54530 - DNA, 300 bp, Homo sapiens
  misc_feature 12: n = A,T,C or G
ttatctaaaagnttgtcttcttgcttcacgaaattcatgttctctttctgtgttgccatggtttctggtcatggatattttctccactaaggaagaataaatctaatcacaagcaaaatattcccttctcaaagcatgcttctccataagatgtacgctcacgttaaaaaaaatcaaacatgtagaattatatcgtatacatagaaatattaaaatacagtggaaaagtattgtatattggaaaaattacgggttttaaggtaaacagagttgggttcatatcagttttatcacttaacc

SEQ ID NO: 54531 - DNA, 410 bp, Homo sapiens
  misc_feature 365: n = A,T,C or G
ataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtntttgaaaacacttagtatgcagttgataagaggaatttggataat

SEQ ID NO: 54532 - DNA, 300 bp, Homo sapiens
  misc_feature 97, 267: n = A,T,C or G
aatccaggagctgcaggctcagattcaggaacagcatgtccaaatcgatgtggatgtttccaagcctgacctcacggctgccctgcgtgacgtacgncagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagnggatgccccttaaaggaaccaatgagtccctgg

SEQ ID NO: 54533 - DNA, 440 bp, Homo sapiens
acctttttataacccatgttttgatcttattgaatgttactttgaaaatgtataactactgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatgtatgtaaccttcccagagtcacagtgtaaagttagatgttgaaacccagtttatcttatacgaatgagcctctgcttgttctacaaaggtagtagaatcaatctcgacctata

SEQ ID NO: 54534 - DNA, 460 bp, Homo sapiens
  misc_feature 2, 46: n = A,T,C or G
tncttcggtttttctcttccttcgctaacgcctcccggctctcgtnagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatg

SEQ ID NO: 54535 - DNA, 275 bp, Homo sapiens
ttctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattaagattgaataaagcaaaatactcaggtgagcatcctgcctcctgttcccaaaaaaaaaaaaaaaaaaaaaaaaaa

SEQ ID NO: 54536 - DNA, 300 bp, Homo sapiens
  misc_feature 28: n = A,T,C or G
cctaaaaggaagtaatttcgtaaagtantttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgg

SEQ ID NO: 54537 - DNA, 170 bp, Homo sapiens
aattctcatgtgggattccccttgccaggatggcctttggatctctcttccaagcctttcctgacttcctcttagatcatagattggacctggttttgttttcctgcagctgttgacttgttgccctgaagtacaataaaaaaaattcattttgctccaaaaaaaaaaaa

SEQ ID NO: 54538 - DNA, 400 bp, Homo sapiens
cagtgaaatccaaaggaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatggggtttccttattgaaaaatcagtgtattagtcataaaacaccatcattaagaataattgaacaat

SEQ ID NO: 54539 - DNA, 500 bp, Homo sapiens
  misc_feature 34: n = A,T,C or G
taggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttg

SEQ ID NO: 54540 - DNA, 500 bp, Homo sapiens
tttggcatgatattcagcatggtcctctgctgtgcaataccgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaggaacaacctatttcgctcccagaaaaaaaagatcaaagagctttcagaaactttgagaacttggctatttagaaaaagtgataatgggtcaggttctcagactgtagccattgaaaattagatgcagagaattcagagatttctt

SEQ ID NO: 54541 - DNA, 170 bp, Homo sapiens
  misc_feature 55: n = A,T,C or G
cagcaatgcagctcaaaacgcttagcctagccacacccccacgggaaacagcagngattaacctttagcaataaacgaaagtttaactaagctatactaaccccagggttggtcaatttcgtgccagccaccgcggtcacacgattaacccataaaaaaaaaaaaaaaaa

SEQ ID NO: 54542 - DNA, 430 bp, Homo sapiens
  misc_feature 41: n = A,T,C or G
attgcacgcataatttttagcttagggcctggtggctaggncggtatctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcat

SEQ ID NO: 54543 - DNA, 340 bp, Homo sapiens
  misc_feature 304, 327: n = A,T,C or G
aaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaacngttattttgggggtagaaacggngaaatctctagcc

SEQ ID NO: 54544 - DNA, 320 bp, Homo sapiens
  misc_feature 220: n = A,T,C or G
gaaaaagttttggtttaacccgagcataagctggaaaagagcttgtcccatgaacccaggctctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggntggtatttgtaatgaatggtgattttaattagtcattagccataatgatgtttatttacagtataactcctgaatgctacttaaataaaccaggattcga

SEQ ID NO: 54545 - DNA, 317 bp, Homo sapiens
tcgtgagtcacacaaactatggcacattctttggaaggtgctggttcctagactttcaggtttcctgggctagggacacagcaaaaagagtctgtttatttctctatttaaaagtttaaaaattaccaacatctggcacagcaatccatcaaaaagaaatatgagctgggcacggtggctcatgcccgtaatcccagcactttgggaggccaaggcaggaggatcgcttgaggccacgagttccagaccagcctgggcaacacagcaagacccctgtctctattcaaccaaaaaaaaaaaaaaaaaaaaaaaaaaaa

SEQ ID NO: 54546 - DNA, 390 bp, Homo sapiens
cgccatggctcctaaaggcagctccaaacagcagtctgaggaggacctgctcctgcgggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggtttgactcctgtttaaagtatggcca

SEQ ID NO: 54547 - DNA, 138 bp, Homo sapiens
acagtgtggccgagcagtatggctatgtgcctagagggcaaagtagttggagttctatcttaggaaaatcaaggcccgcaaaggcaaataaatccttgttttgtcttcacccatgtaaaaaaaaaaaaaaaaaaaaaa

SEQ ID NO: 54548 - DNA, 350 bp, Homo sapiens
  misc_feature 31, 342: n = A,T,C or G
aactgaaataaatagtaaatagtttcttgcnatctgttcacccacatcactgttgtttcatacctccttttcacaaatcctagcatagggtttctcactggataggcattatcttgtttattgaatgaagaaggaaacagacacaaggtggtttgtccacgtaagtgggatttagttatatgggaatgtttatggaaggcaggctattactttgtttctctttagtttggatcttttttgtctcatagggagatgcaagatacatgtgtatttatcttatttccatgtactagaaaataagatcccaaagggtaggggatctttctgttgcctttgccctgngatgtttc

SEQ ID NO: 54549 - DNA, 260 bp, Homo sapiens
gaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtattgtacatattgtatgattcaacatttttaaaggcagattgtttttagtaaaatgtagcttttgatagctaaaaaaaaaaaaaaaaaaaaaaaaaaaa

SEQ ID NO: 54550 - DNA, 400 bp, Homo sapiens
  misc_feature 5, 87, 333: n = A,T,C or G
ttatnattcattcttagctcttaattgttcattttgagctgaaatgctgcattttaattttaaccaaaacatgtctcctatcctggnttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgnaattcctacctccctgcaaccaactacaaccaagctctctgcatctactcccaagtatggggttcaa

SEQ ID NO: 54551 - DNA, 383 bp, Homo sapiens
  misc_feature 1: n = A,T,C or G
nggatttccttgccgaccgagggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccagatttaaattatatggttttgtgctctcatttattatcatttttttctgtacaaatctattatttctagatttttgtataacatgatagacataaaattggtttatctcctccaaggaaaaaaaaaaaa

SEQ ID NO: 54552 - DNA, 140 bp, Homo sapiens
  misc_feature 28, 53, 81, 95: n = A,T,C or G
ttttttctctttgaaagatagagattantacaactacttaaaaaatataggcnataggttacctaagatattgcttagcgntaagtttttaacgnaattttaatagcttaagattttaagagaaaatatgaagacttaga

SEQ ID NO: 54553 - DNA, 234 bp, Homo sapiens
gagaagttggtgagcagcggcttccgagtaaaacggctcgagcagcgacaacccgtcctctcccgagtttttcataactgagcccactcgcaggttggagccatcagtgggatacgccacattttggaagccccagcatcgtgtacttaccagtgtgttcacaaaatgaaatttgtgtgagagctgtacattaaaaaaaatcatcattattcaaaaaaaaaaaaaaaaaaaaaa

SEQ ID NO: 54554 - DNA, 430 bp, Homo sapiens
  misc_feature 10: n = A,T,C or G
acaactcggnggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaagaccgcgcctgcctttcccatctgtctatctatctggctggcagggaaggaaagaacttgca

SEQ ID NO: 54555 - DNA, 380 bp, Homo sapiens
  misc_feature 29: n = A,T,C or G
attgatgcaggatattacatttgcactgntcagaatcttcaaggacagaccacagtagctaccactgttgagttttcctgacttggaaaaggaaatgtaatgaacttatggaaagcccatttgtgtacacagtcagctttggggttccttttattagtgctttgcctgaggctgatgtcaagcaccacaccccaaccccagcgtctcgtgagtccgacccagacatccaaactaaaaggaagtcatccagtctattcacagaagtgttaacttttctaacagaaggcatgattttgattgcttacctacatacgtgttccctagtttttatacatgtgtaaacaattttatataatcaatcatttctattaaatgagcac

SEQ ID NO: 54556 - DNA, 400 bp, Homo sapiens
  misc_feature 7: n = A,T,C or G
cagcagnaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggctgaggcatgagctggacttcatgtttccctcaaagactctcccgtggatgacggatgaggactctgggctgctggaataggacactcaagacttttgactgccattttgtttgttcagtggagactccctggccaacagaatccttcttgataagtttgcaggcaaaacaaatgtaatgttgcagatccgcaggcagaagctctgccccttctgtatc

SEQ ID NO: 54557 - DNA, 220 bp, Homo sapiens
  misc_feature 23: n = A,T,C or G
cagattatttgcccaaagttgtngctcttcttcgattgcagcatttgttctttgccagtctcattttcatcttcttccatggttccacagaagctttgcttcttgggcaagcagaaaaattaaattgtacctattttgtatatgtgagatgtttaaataaattgtgaaaaaaatgaaataaagcatgtttggttttacaaaaaaaaaaaaaaaaaaaaaa

SEQ ID NO: 54558 - DNA, 285 bp, Homo sapiens
atatggatgttactctcttgcaccaaattatcttgatacattcaaatttgtctggttaaaaaataggtggtagatattgaggccaagaatattgcaaaatacatgaagcttcctgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggtaaaaaaaaaaaaaaaa

SEQ ID NO: 54559 - DNA, 420 bp, Homo sapiens
cctttctaactccgctgccgccatggctcctgtgaaaaagcttgtggtgaaggggggcaaaaaaaagaagcaagttctgaagttcactcttgattgcacccaccctgcagaagatggaatcatggatgctgccaattttgagcagtttttgcaagaaaggatcaaagtgaacggaaaagctgggaaccttggtggaggggtggtgaccattcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcattta

SEQ ID NO: 54560 - DNA, 238 bp, Homo sapiens
ctatctgcattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgtttttttcttcgttctgtaataaacagccaggagaaaagtgaaaaaaaaaaaaaaaaaaaaaaaaaaaaaaa

SEQ ID NO: 54561 - DNA, 167 bp, Homo sapiens
taataaaccttgatggcattgggcaaacagtagacttcagtagggttggggtagcccatgttatgtgactatctttatgagaattttaaagtggttctggatatcttttaacttggagtttcatttcttttcattgtaatcaaaaaaaaaaaaaaaaaaaaaaaaaa

SEQ ID NO: 54562 - DNA, 300 bp, Homo sapiens
tcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgct

SEQ ID NO: 54563 - DNA, 365 bp, Homo sapiens
  misc_feature 18, 55: n = A,T,C or G
acaactctgagctgctgnacatgttagagtcccccgagtctctccgctccaaggnggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatgggcctcaacaccaaggattacaaattgcaaatttaataggtcatttttgtatcaaaaggtcaattatgaagcacctagaatttttcaattatacgaatatgttccttttggggttctgctgtggcccagacagtgttaac

SEQ ID NO: 54564 - DNA, 380 bp, Homo sapiens
  misc_feature 56: n = A,T,C or G
cttttccccggttgctgcttgctgtgagtgtctctagggtgatacgtgggtgaganaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactggaagcagtccctgccccccggtttggcaggtgaaggaactgaaatgaaccagacacactgattggaactgtattatattaaaatacttaaaaatccaaaaaaaaaaaaaaaaaaaa

SEQ ID NO: 54565 - DNA, 440 bp, Homo sapiens
tgaaggcagtttttttggcgttttgtagtaaattctgtaaaatactttggtttaatttgtgacttttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaacca

SEQ ID NO: 54566 - DNA, 338 bp, Homo sapiens
tctctgtcctacttctgactttacttgtggtgtgaccctgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaaaaaaaaaaa

SEQ ID NO: 54567 - DNA, 248 bp, Homo sapiens
  misc_feature 11: n = A,T,C or G
aactggaggtnaggagtttgagaccagcctggccaacatggtgaaaccctgtttctactaaaaaatacaaaaattagccaagcttggtggtgcacgcctgtaatcccagctactcgggaggctgaggcaagagaatcgcttgagcccatgaggcggaggttgcagtgagccaagattgtgccattgcactccagcctgggtgacaagagcaagactccatcttaaaaaaaaaaaaaaaaaaaaaaaaa

SEQ ID NO: 54568 - DNA, 430 bp, Homo sapiens
aagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaa

SEQ ID NO: 54569 - DNA, 500 bp, Homo sapiens
acagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcct

SEQ ID NO: 54570 - DNA, 510 bp, Homo sapiens
aataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacaggtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactt

SEQ ID NO: 54571 - DNA, 410 bp, Homo sapiens
  misc_feature 176, 342: n = A,T,C or G
gccaacatggtgttcaggcgcttcgtggaggttggccgggtggcctatgtctcctttggacctcatgccggaaaattggtcgcgattgtagatgttattgatcagaacagggctttggtcgatgggccttgcactcaagtgaggagacaggccatgcctttcaagtgcatgcagcntcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagntatgaaggcaaagaaaatgaggaacagaataatcaagaatgaagttaagaagcttcaaaaggcagctc

SEQ ID NO: 54572 - DNA, 303 bp, Homo sapiens
  misc_feature 26: n = A,T,C or G
tggaaaatgggtaaggaacaatcaanttcaattcgggaagactctagaggtggtaataatttggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaaaaaaaaaaaaaaaaaa

SEQ ID NO: 54573 - DNA, 310 bp, Homo sapiens
gttgattttgtgtctcctttcaaattttaatttaaaattactggttttcattttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataacctgaatttag

SEQ ID NO: 54574 - DNA, 370 bp, Homo sapiens
  misc_feature 21: n = A,T,C or G
acactaagggcgactaccagnaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgccaaaaaaaaa

SEQ ID NO: 54575 - DNA, 520 bp, Homo sapiens
  misc_feature 380: n = A,T,C or G
aagtaaactagcttagtaataaatattttataatgattacatgttgaaataatattttggatgtactattaaaataattttacctgtgtctttttacttttttttaaatgtggccgcttaatattacataggtagctcatagttgttgctgatattacatttctgttgtacagccctactctagagacttactgcacatgttgaatgcattctttaatataaaacttttatctggtcctccatcccaaatatatattatggtgcccaaaactttaatttttatttttgcattccttcccatcagtagctcaaacaacctgtgttttaggtaaagtattttaatgtttaaatgtggaatacatttatattttaattggagntgaaactataagcccattctgcttgatttcttccatgtcacacaagtttattgataacactcttttctggtagcacaagtcatgtcactaggtatctcatattactttaataatctacattacgtatgttaagaatagag

SEQ ID NO: 54576 - DNA, 330 bp, Homo sapiens
  misc_feature 110, 151, 217: n = A,T,C or G
caatctgggcgatcgcttctctggtcctcgcctcctccgctgtctccctggagttcttgcaagtcggccaggatgtctcaggctgagtttgagaaagctgcagaggaggntaggcaccttaagaccaagccatcggatgaggagatgctgntcatctatggccactacaaacaagcaactgtgggcgacataaatacagaacggcccgggatgttgnacttcacgggcaaggccaagtgggatgcctggaatgagctgaaagggacttccaaggaagatgccatgaaagcttacatcaacaaagtagaagagctaaagaaaaaatacggg

SEQ ID NO: 54577 - DNA, 190 bp, Homo sapiens
  misc_feature 37, 49, 67, 94, 95, 154, 173, 176: n = A,T,C or G
aaaaatgaattggagttactcatgtgaaaaaactgtnacgcaatggaantgaggaaacatgtaagantatatcatgttaaaattaacagctganngccagcttttagctgtaacaggtataagctcctacttgtgtcactatgtaagattttgncaaagactttttgccttangtnatgtaattatccat

SEQ ID NO: 54578 - DNA, 312 bp, Homo sapiens
attaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcacttgtacacttgtataagtaccgtttacttcatggcatgaataaatggatctgtgagatgc

SEQ ID NO: 54579 - DNA, 303 bp, Homo sapiens
  misc_feature 244: n = A,T,C or G
ccaaactctatctgaaatcccaacaaaaaaaatttaacttcatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactctttatgataacaaaaaaaaaaaaaaaaaaaaaa

SEQ ID NO: 54580 - DNA, 460 bp, Homo sapiens
actgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgacc

SEQ ID NO: 54581 - DNA, 208 bp, Homo sapiens
cagctggagaaatggcgtcattataagctatgagttgaaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaagaaaaaaaaaaaaaaaaaaaaaaaaa

SEQ ID NO: 54582 - DNA, 120 bp, Homo sapiens
  misc_feature 27, 51, 66, 70, 71, 89, 104, 107: n = A,T,C or G
cagaaactcattgaagtggacgatgancgcaaacttcgtactttctatganaagcgtacggccacncaanntgctgctgacgctctggntgaagaatggaaggnttntgtggcccgaatc

SEQ ID NO: 54583 - DNA, 131 bp, Homo sapiens
  misc_feature 10, 22: n = A,T,C or G
gattcgaagnaacccgtatacntaaaatctagacaaaaaaggaaggaatcgaaccccccaaagctggtttcaagccaaccccatggtctccatgactttttcaaaaaaaaaaaaaaaaaaaaaaaaaaaaa

SEQ ID NO: 54584 - DNA, 320 bp, Homo sapiens
  misc_feature 306: n = A,T,C or G
atggcgaaagcctgtctgtactacaaatacaaaaatgagctgggcatggtgccgtgcgcctgtaaccccagctactctggaggctgaagaggagaattacttgaacctgggaagctgaggttgcagtgagccgaggtcacaccactccatcttgggcgacagagtgagatcccgtctcggggccggcggagggaggaaggttttgagactaagaataaactgtttctttccccaccaaccaggcaaatgctagctgatactgtaagcttagaagtttcttttatccacaccttggccatattctancccaaaaaaaaaaa

SEQ ID NO: 54585 - DNA, 300 bp, Homo sapiens
cccctgcgcaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccacc

SEQ ID NO: 54586 - DNA, 400 bp, Homo sapiens
tatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaacctgtttcttttgtgccattttggggtggagaaggtggatgtgatgaagccaataattcaggacttatt

SEQ ID NO: 54587 - DNA, 500 bp, Homo sapiens
aaggtgaacaaatgatgacaggattgacgtttttgtttgaatgttccattttatttaattttttttctcattttctttgttttattatctctgatcttttatttggcttcatttataaatcaaagagataggaaatttgtgcgtcccgctttgccatgtttgtcagacctcacgagtatgttttggtacatttgtgttctgtttgttattgtttttaaagtctaagcctgactgaaggcagagttcagttgtgcaggtcagttcttcagattaagtctgagagaaagtataaaaaaaggaaaatttctatgattgtgtccatgtgtacatactgatgctttgatttatcttcttttcttttcctgcagttgattgaaatgtcctttttcctctggtgggaaaaagagaacgatagcaggcaaatcatttgagcattgcttcgggtttgtatttatctctctttttttttgctttgaatagagctattgcaataaaaaatg

SEQ ID NO: 54588 - DNA, 190 bp, Homo sapiens
gctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgcaaaaaagaaaaaaaaaaaaaa

SEQ ID NO: 54589 - DNA, 257 bp, Homo sapiens
  misc_feature 219: n = A,T,C or G
gggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcaggagttttctaagaagtgctcagagaggtggaagaccntgtctgctaaagagaaaggaaaatttgaagatttggca

SEQ ID NO: 54590 - DNA, 250 bp, Homo sapiens
  misc_feature 211, 234: n = A,T,C or G
atgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgnatgtgccaaagctttactactgnggaaagacaactggtt

SEQ ID NO: 54591 - DNA, 470 bp, Homo sapiens
  misc_feature 11, 192: n = A,T,C or G
ctcttactatnggaattggcaccagctaagaaaatttacggtttaatactttcgagcaaataattgcttagggtgctttaaatagcacaggaaatgtgtagagtgtttacttgacatttgctatattgaacactaatactgaaacagattctttgaccacagagaatgccagtgtaggaggggtgggggtanggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccg

SEQ ID NO: 54592 - DNA, 500 bp, Homo sapiens
  misc_feature 11, 24, 25, 26, 201: n = A,T,C or G
cattcctgagnctgacagcattcnnnccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagntgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgcccgcatttggattggatgaattccaaattctgcttgcttgctttttaatattgatatgcttatacacttacacttttatgcac

SEQ ID NO: 54593 - DNA, 199 bp, Homo sapiens
  misc_feature 120: n = A,T,C or G
acgcttagcctagccacacccccacgggaaacagcagtgattaacctttagcaataaacgaaagtttaactaagctatactaaccccagggttggtcaatttcgtgccagccaccgcggncacacgattaacccaagtcaatagaagccggcgtaaagagtgttttagatcaccccctcccctaaaaaaaaaaaaaaaa

SEQ ID NO: 54594 - DNA, 220 bp, Homo sapiens
  misc_feature 28, 53: n = A,T,C or G
aacctgggtctataaggaattgcacatntagatggcacacatatttatgctgnctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaagaaaaaaaaaaaaa

SEQ ID NO: 54595 - DNA, 269 bp, Homo sapiens
  misc_feature 78, 172, 177, 253: n = A,T,C or G
cctcaaagcttggattaaatacatatggatgttactctcttgcaccaaattatcttgatacattcaaatttgtctggntaaaaaataggtggtagatattgaggccaagaatattgcgaaatacatgaagcttcctgcacttaaagaagtatttttagaataagaatttgcntactnacctagtgaaacttttctagaattatttttcactctaagtcatgtatgtttctctttgattatttgcatgttatgnttaataagctactagc

SEQ ID NO: 54596 - DNA, 390 bp, Homo sapiens
tccatggctgctttcacatgacaacattagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagc

SEQ ID NO: 54597 - DNA, 340 bp, Homo sapiens
  misc_feature 319: n = A,T,C or G
caggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcgttcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggntcatgacaccagttacatccg

SEQ ID NO: 54598 - DNA, 430 bp, Homo sapiens
  misc_feature 162, 204, 231, 380, 414: n = A,T,C or G
aaattttcttaataagtcctaaacccaagaataaacttttatatttttttttctgcttcatagctgtggaaaattattgcaaccaaactattgaaaccattcttaaagttaaaagaattgttattttaggacaaattttgaagataatacttttttgggggnggggaacttctgctgctattgttgctgtgctggaggaatggngcttattcttttggtagcgtaactagnggtctgacatgaaaaactcttaaaacttaccctatattgggtctttaactgctattttatgttaaaaccttacatattagtatgtatatatatatgggaatgcatacatatacaaactacattttcttatttttaaaatatcttaaggnacatgaaggagttaacatgttcatgaaacattgngacatgggaaatgtac

SEQ ID NO: 54599 - DNA, 240 bp, Homo sapiens
  misc_feature 22, 23, 239: n = A,T,C or G
agcaaattgatgttctaactgnngttttatagaaagtattaatgcttttatgtatttcaaaactttcatatgctaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcnt

SEQ ID NO: 54600 - DNA, 500 bp, Homo sapiens
  misc_feature 378, 391: n = A,T,C or G
gccaaattctactcattcttttcatgctccctttgagtttcttttgaggattttatcactttgtacattgagttaggaatgcagctcacaaatccttgggaagctgctcttatgctccaggcactgggatcagctagggctatgacagtgaactagagaagcaagcaccctacccccaggagcccaccttctagggagattcttgtgttatgcttatttaaatgtatgtcccagctgggtgcggtggctcaggcctgtaatcccagcactttgggaggctgagacaggtagatcacgagatcaggagttcgagaccggcctgaccagcatgatgaaaccccatctctactgaaaatacaaaaattagctgggcgtggnggtgcgcacctgnaaccccagctactctggaggctgaggcgggagaatcacttgaacccgggaggcggaggttgcggtgagcccgagatcgcgccacctgcactccagcttgggcaacagga

SEQ ID NO: 54601 - DNA, 340 bp, Homo sapiens
  misc_feature 28, 239, 300: n = A,T,C or G
caagacttttgactgccattttgtttgntcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagncgatacaatgcgtagatagaagaagccccacgggagccaggatgggactggtcgtgtttgngcttttctccaagtcagcacccaaaggtcaatgcacagag

SEQ ID NO: 54602 - DNA, 210 bp, Homo sapiens
  misc_feature 30: n = A,T,C or G
atagcatggaaatatactttatattttgtntcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgacaaagttaaagaaaactcaaaaaaaaaaaaaaaa

SEQ ID NO: 54603 - DNA, 230 bp, Homo sapiens
  misc_feature 25, 99, 203: n = A,T,C or G
agaggcaacgaggagaggctgattncagtgcagagtacgtttgacaatgagtcagtagcacaaaagagatgacatttacctagcactataaaccctggntgcctctgaagaaactgccttcattgtatatatgtgactatttacatgtaatcaacatgggaacttttaggggaacctaataagaaatcccaattttcaggagnggtggtgtcaataaacgctctgtggcc

SEQ ID NO: 54604 - DNA, 550 bp, Homo sapiens
  misc_feature 24: n = A,T,C or G
agtggacgtgtcttttgaaactgntgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttccttttgtgagagactgcatatcaaagtcattcccacactagcactgctaaaagatggga

SEQ ID NO: 54605 - DNA, 291 bp, Homo sapiens
  misc_feature 17: n = A,T,C or G
ccacaggaagacctgcnccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaaaaaaaaaaaa

SEQ ID NO: 54606 - DNA, 189 bp, Homo sapiens
  misc_feature 176: n = A,T,C or G
agatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatntctggggagggaa

SEQ ID NO: 54607 - DNA, 307 bp, Homo sapiens
  misc_feature 3: n = A,T,C or G
atnaaacagaattctatttgggcaagatatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggacaaaaaaaaaaaaaaaaaaaaaaaaaa

SEQ ID NO: 54608 - DNA, 450 bp, Homo sapiens
  misc_feature 370: n = A,T,C or G
gggtaatttcatgtttattaaactcgaactttggctagttaaactcatattgaaacttcctctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggncaggaaccaactttactggcaaaagggtccatgtaccaccatgtgctggagcatctgttctacatgtggatatctattga

SEQ ID NO: 54609 - DNA, 386 bp, Homo sapiens
  misc_feature 4: n = A,T,C or G
aagnagcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacctagtatgcagttgataagaggaatttggtataattatggtgggtgattattttttatactgtatgtgccaaagctttactactgtggaaagacaactgttttaataaaagatttacattccaaaaaaaa

SEQ ID NO: 54610 - DNA, 290 bp, Homo sapiens
  misc_feature 48, 109, 184: n = A,T,C or G
gaccaagggcaaaggctacaaaggggtcaccagtcgttggcacaccanagaagctgccccgcatgacccaccgaggcctgcgcaaggtggcctgtattggggcatggcntcctgctcgtgtagccttctctgtggcacgcgcgtgggggggaaaggctaccatcaccgcactggggatcaacangaagatttataaggattggccagggctaccttatcaaggacggcaagctgttcaagaacaatgcctccactgactatgacctatctgacacgagcatcaaccctct

SEQ ID NO: 54611 - DNA, 430 bp, Homo sapiens
tcagaatatttattttacttacaatcctcaagttttaattgattttaaatatttttcaatacaacagtttaggtttaagatgaccaatgacaatgaccacctttgcagaaagtaaactgattgaataaataagtctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaa

SEQ ID NO: 54612 - DNA, 500 bp, Homo sapiens
agccattgaggcagccagcgcagggtttttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattgggagatag

SEQ ID NO: 54613 - DNA, 500 bp, Homo sapiens
  misc_feature 25: n = A,T,C or G
atgacccccaatactgggtttggtnctcattctcgttaatgcatgtgttaagggtttcattctaatcatctgcaaaaaagtgattgttgtctttaaaatgttaccaaaactagtcttttagcaagaatcttactagaataaaatggctcttgctacctgtatttttaatcagcctatgtatattgatcccattcctgatattatcaccttaatatataacagccccaattcctcttattgagcattggttgctagggaaagcaaaaagttaagagaaaactactgagattttctctctaatttgcctctgtctgcctctaactagcttagagatcttggacaagtcctttaacagttctctgtcagctgcttggactgtgaaatagagataaaagtacctgtctatttcaggccgggcacggtggctcacgcctgtaatcccagcactttgggaggcccaggagggtggatcaccgaggtcaggagattgagaccatcct

SEQ ID NO: 54614 - DNA, 500 bp, Homo sapiens
  misc_feature 10: n = A,T,C or G
gctgtgccanaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggtacccccaatctgaagtcagtaaatgaactaatctacaagcgtgggtatggcaaaatcaataagaagcgaattgctttgacagataacgctttgattgctcgatct

SEQ ID NO: 54615 - DNA, 265 bp, Homo sapiens
  misc_feature 24: n = A,T,C or G
caaaacagattgtttgcaaagggnaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttcta

SEQ ID NO: 54616 - DNA, 400 bp, Homo sapiens
  misc_feature 15: n = A,T,C or G
agtgacttccaaggnaaatggctattcaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacgatcattgaatacaaaacaaataagccatcacgcctgcccttccttgatattgcacctttggacatcggtggtgctgaccaggaattctttgtggacattggcccagtctgtttcaaataaatgaactcagtctaaattaaaaaagaaag

SEQ ID NO: 54617 - DNA, 203 bp, Homo sapiens
aataatgtgtctgtaaccaagaaaatattgatagcatcatcctaatgaaacttgggtttgtttgtttttttactgctcactcccaaccttttgtaatgccattttctaaacttatttctgagtgtagtctcagcttaaagttgtgtaatactaaaatcacgagaacacctaaacaacagccaaaaaaaaaaaaaaaaaaaaaa

SEQ ID NO: 54618 - DNA, 160 bp, Homo sapiens
  misc_feature 6: n = A,T,C or G
aatcancagtaaaaagtctttaactccaccattagcacccaaagctaagattctaatttaaactattctctgttctttcatggggaagcagatttgggtaccacccaagtattgactcacccatcaacaaccgccaaaaaaaaaaaaaaaaaaaaaaaaa

SEQ ID NO: 54619 - DNA, 390 bp, Homo sapiens
gtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaa

SEQ ID NO: 54620 - DNA, 430 bp, Homo sapiens
  misc_feature 208: n = A,T,C or G
aattgacatcagctcaacctaaattaccttgctgggccctcttagctgttgcccaatgaaagaaaacataaagaaaaaaaaataaggtacatttaaattactttccaaagctgatttttttgtcttttctttttttactgaaacaagaaactctcagatgcaagtcaaaaagcagaaaatattttacaatattaaaaagtcatctgtngttaggttcggcatattaatgagatcctgagcactgagcatttatggacaatatggccttcgtttgatgcataaaaaggaaattcaacacaaacacgttgttaaaaccgtgccagaagatgcgctagagttttctctcattttaattacaatcagtgccagtatctgtattacctgtgaaggcctccaagaaagggtcatggaagcttattgggaataatcc

SEQ ID NO: 54621 - DNA, 394 bp, Homo sapiens
  misc_feature 30, 54: n = A,T,C or G
agtaaagtggatggacatgatggaattcanttgtctcaccctgatagcctgggngttgatattcactttacccgcactcagacacaggcgaccttgaagcagttctcggtgtgtagagtccacgtgacagtccccacagcctccccagatagctgtgtgcctgtgcgctacttgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaatactaggaaaaaaaaaaaaaaaaaa

SEQ ID NO: 54622 - DNA, 250 bp, Homo sapiens
atatgcattctttgaaagacactactgaaattaactcaaaaagaaatagaaggtctcttttgtttgtttcagatggagtcttgctctgttgctcagggtggagtgcagtgatgtgatgttggctcactgcagcgtttgcctcctgggttcaagtgattctcctgcctcaacctcccaaagaaatagaaaatctaaatagaccaataaagtaaagagattgaattagccaaaaaaaaaaaaaaaaaaaaaa

SEQ ID NO: 54623 - DNA, 480 bp, Homo sapiens
  misc_feature 31, 32: n = A,T,C or G
agaaaccaattctatatataccatttctttnnaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagccaataatttgctagttaggtagtcaaaga

SEQ ID NO: 54624 - DNA, 210 bp, Homo sapiens
atgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccaaaaaaaaaaaaaaaaaaaaa

SEQ ID NO: 54625 - DNA, 348 bp, Homo sapiens
  misc_feature 18, 206: n = A,T,C or G
cataccataagtttattnggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgnacttggcttaactcaagaacagtttcttctggattccttatttgatttatttaacctaattatattctaatattgcaaatattaccataagtgggtaaaagtaaaattcctcttctgataaaaaaaaaaaaaaaaaaaaaaa

SEQ ID NO: 54626 - DNA, 440 bp, Homo sapiens
  misc_feature 4, 208, 292: n = A,T,C or G
aaanagaaactgtgataatacccaatgataaaagtcttcaattacaaaaaggatgaggcaataacaccattacctcccaagaaagaaaatggtgaaatgcccacgtgtctgctgtgtgtttgtttaagtggctctgtatactgtgaagaagttgacattgatgctgtaccacccttaccaaaggaatcagcctatctttacgcacgantcaacaaaattaaaaagctgactgccaaagattttgcagacatacctaacttaagaagactcgattttacaggaaatttgatangaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatca

SEQ ID NO: 54627 - DNA, 433 bp, Homo sapiens
  misc_feature 70, 334, 336, 344, 347, 350, 354, 356, 358, 364, 365, 366,367, 368, 371, 372, 373, 375, 382, 383, 384, 389, 393, 401,404, 407, 411, 413, 417, 425: n = A,T,C or G
catactagatagaaatccgattctgtacaaattaccaatatcaagaacaagaaaggtgacatcactatangagtcacagatgtttgaaggataataagtgaatattataattaactttttgccaataatattcaacttttgaagaaatgcacacaatttcttgaaactagcaaactaccaaagcttactcaagaagaaacaggtaacttgaatagtcctatatttaaggaaattgaacttgtaaaccttctgacaaaactgcaggcccagatggcttcactgttgaattctactgtatatttaaaaaaaaaaaaaaaaaaaaaaaaaaaaaccntngggggccnccnggncccngngntttttnnnnnggnnnanctttttnnnggggnccgnatttgggnccnctnggcnantttncccccttntggggggg

SEQ ID NO: 54628 - DNA, 430 bp, Homo sapiens
  misc_feature 204, 207, 375: n = A,T,C or G
gaagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggnggntaacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatntggaagacacagatgatgatgatgatgatgatgatgatgatgatgatgatgatga

SEQ ID NO: 54629 - DNA, 325 bp, Homo sapiens
cgtctatggcaactggaatggcccccaccgcctctatctgcaaatgagcacccatgggaaggtccgcttccgggtaagaaggggcctcaccccaggagttcaagaccagcctgtccaacatggcaaaaccctgtctctactaaaaataccaaaaattggccaggtgtggtggtgcgtgcctataatcccagctactccggtagctgaggcacaggaatcttgagcccaggaggcagaggttacagtgagctgagatcgtgctactgcactccagcctgagtgacagagcgagactccatctcaaaaaaaaaaaaaaaaaaaaaaa

SEQ ID NO: 54630 - DNA, 400 bp, Homo sapiens
tcgtttttgatgctcgatgaatgctgtgaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccac

SEQ ID NO: 54631 - DNA, 330 bp, Homo sapiens
  misc_feature 26, 286: n = A,T,C or G
agtcggagctcggcaggaagtgggancggtgtctggcggatgcgggcgtgaagataggaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaaatgntttcagtaatgctttaaactccagcaccctgggtatgcattttg

SEQ ID NO: 54632 - DNA, 500 bp, Homo sapiens
  misc_feature 442: n = A,T,C or G
aatgccctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggntaaaaaataggtgggagatattgaggccaagaatattgcaaaatacatgaagcttcat

SEQ ID NO: 54633 - DNA, 440 bp, Homo sapiens
  misc_feature 4, 380, 426: n = A,T,C or G
aaantttttaatttccaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgngtaatctaaagtatatgtgagaaatcagaattgggcataattttgncttagttgataatt

SEQ ID NO: 54634 - DNA, 150 bp, Homo sapiens
ctctttggacactaggaaaaaaccttgttgagagagtaaaaaaatttaacacccatagtaggcctaaaagcagccaccaattaagaaagcgttcaagctcaacacccactacctaaaaaatcccaaaaaaaaaaaaaaaaaaaaaaaaaa

SEQ ID NO: 54635 - DNA, 440 bp, Homo sapiens
aacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaaca

SEQ ID NO: 54636 - DNA, 410 bp, Homo sapiens
  misc_feature 5: n = A,T,C or G
atatnttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgggaaataaatg

SEQ ID NO: 54637 - DNA, 126 bp, Homo sapiens
agttacaggtaaagttagtgtaaaggaagaatagcaatacaaagtgtccaatttttttttgcagttctctctattgaacatcatgagtcacgatgatgtatcaatgagttgtatttccatttgtgg

SEQ ID NO: 54638 - DNA, 440 bp, Homo sapiens
  misc_feature 3, 11: n = A,T,C or G
agngaacgganagcgtagtgaccatcatgagcctcctcaacaagcccaaggagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccat

SEQ ID NO: 54639 - DNA, 500 bp, Homo sapiens
  misc_feature 14, 488: n = A,T,C or G
agtgtaaagaaatngtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaaccctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggnaaacagctgtct

SEQ ID NO: 54640 - DNA, 250 bp, Homo sapiens
agcgaacggggaggagcccagagcctgaatcagtgtgtgtgttagtggaagcgtctggaaaggcgtgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcaaaaaaaaaaaaaaaaaaaaaaaaa

SEQ ID NO: 54641 - DNA, 360 bp, Homo sapiens
  misc_feature 28: n = A,T,C or G
aatgagcccatagctgcttccttccagntgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaattttaaaaaaaaaaaaaaaaaaa

SEQ ID NO: 54642 - DNA, 400 bp, Homo sapiens
  misc_feature 20, 52: n = A,T,C or G
ctactgcagtcattcaaggnagtctatggtaaaggacaaaaggaaagagagnaaatcatcacctagtaaggaaaatgagtcgagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttc

SEQ ID NO: 54643 - DNA, 464 bp, Homo sapiens
  misc_feature 14: n = A,T,C or G
gatctgctttaagnaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtggtgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggaggagttttctctaaattgaaacaactgaagaagctgcatataaaccacaacaacctgacagagtctgtggg

SEQ ID NO: 54644 - DNA, 345 bp, Homo sapiens
gctttccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggac

SEQ ID NO: 54645 - DNA, 330 bp, Homo sapiens
  misc_feature 39, 120, 135, 137, 160, 173, 182, 207, 234, 269, 270: n = A,T,C or G
aggtaaagttagtgtaaaggtttaatagcaatacaaagngtccaatttttttttgcagttctctctattgaacatcatgagtcacgatgatgtatcatgagttgtatttccatttgtggnggtacagtttctgtngntccatccatatattttgaaattnattctaccatganatagctgtnacaactctctgtgtttagaggcagnattaactgactcataccaggaaggagntcatgataataacttcatgattaaatcatgctgtnnccaactgagcaaccttaataccctgaatggtcttaagacatttattttttaatgtgaaaa

SEQ ID NO: 54646 - DNA, 464 bp, Homo sapiens
  misc_feature 29: n = A,T,C or G
gaaacctcggtggtggccactgcgcagantttacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagt

SEQ ID NO: 54647 - DNA, 471 bp, Homo sapiens
  misc_feature 22, 34, 371, 427: n = A,T,C or G
ctgtgccaataactgaaaaagnagacacgagttnaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatattttttttttctgaatganaaacatgagggaaattgtggagttagcctcctgtggtaaaggaattgaagaaaatntaacaccttacaccctttttcatcttgacattaaaagttctggc

SEQ ID NO: 54648 - DNA, 250 bp, Homo sapiens
  misc_feature 22, 28: n = A,T,C or G
agcgaacggggaggagcccagnagcctnaatcagtgtgtgtgttagtggaagcgtctggaaaggcgtgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcaaaaaaaaaaaaaaaaaaaaaaaa

SEQ ID NO: 54649 - DNA, 493 bp, Homo sapiens
  misc_feature 21, 148, 149: n = A,T,C or G
ccatcggtccttacagccgcncgtcagactccagcagccaagatggtgaagcagatcgagagcaagactgcttttcaggaagccttggacgctgcaggtgataaacttgtagtagttgacttctcagccacgtggtgtgggccttgcnnaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacact

SEQ ID NO: 54650 - DNA, 472 bp, Homo sapiens
  misc_feature 30, 436, 439, 460: n = A,T,C or G
atagtccagcattattgccttaaatagatnccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgccccgggagtacctagttttaaacatttccttaacaaggagaacaatccagcaaaaagctttctttctctatacagtgtatatctctaaactttttttcctcagttttagagaacatctgtttatctnggngggtctttgggttggaatgcnaactcataactt

SEQ ID NO: 54651 - DNA, 440 bp, Homo sapiens
tctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtggtgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaac

SEQ ID NO: 54652 - DNA, 270 bp, Homo sapiens
  misc_feature 6, 24: n = A,T,C or G
taaagnctatcagaagaaatcctnacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagacaaaaaaaaaaaaaaaaaaaa

SEQ ID NO: 54653 - DNA, 440 bp, Homo sapiens
  misc_feature 26, 47: n = A,T,C or G
ctcttccggggacgttgtctgcaggntttcagaatggtccagcgttngacataccgacgtaggctttcctacaatacagcctctaacaaaactaggctgtctcgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtaaaaaaaaaa

SEQ ID NO: 54654 - DNA, 253 bp, Homo sapiens
  misc_feature 17, 19, 180: n = A,T,C or G
gtttcaaattcagcggntntgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgngatatttaaatgatgcaataaaagacctattgatttggaccttcttctcaaaaaaaaaaaaaaaaaaaaaaaa

SEQ ID NO: 54655 - DNA, 446 bp, Homo sapiens
  misc_feature 12, 23: n = A,T,C or G
atccaaaaccgnagtctacaagnagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggcaaaaaaaaaa

SEQ ID NO: 54656 - DNA, 470 bp, Homo sapiens
atttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaa

SEQ ID NO: 54657 - DNA, 410 bp, Homo sapiens
  misc_feature 26: n = A,T,C or G
gaccactgggtgagagaggataaggnccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagc

SEQ ID NO: 54658 - DNA, 430 bp, Homo sapiens
  misc_feature 111, 125, 142, 185, 198, 297: n = A,T,C or G
ggtgtctcattaccattacctctacactgcagaagaagcaaaactcctttattagaattactgcacatgtgtatgggaaaatagttctgaaaggctaagaatgatacaagngagcaaaagttggncagcttggctatggagngggggcaataatctctaaacattccaaaagaccatgagctgancctaaactccctnggaatctgaacaaaggaatataaaattgccatttgaaaactgaccagctaatctggacctcagagatagatcagccagtggcccaaagccatttcaagnacagaaattatagagactacagctaaataaatttgaacattaaatataattttaccacctttttgtctttataagcatatttgtaaactcagaactgagcagaagtgactttactttctcaagtttgatactg

SEQ ID NO: 54659 - DNA, 100 bp, Homo sapiens
  misc_feature 12, 20, 42, 75: n = A,T,C or G
aaatgaatgcantctaatanaagcctaatcagcccaccatgntctccactgaaaaatcctctttctttggggttnttctttctttcttttttgattttgc

SEQ ID NO: 54660 - DNA, 258 bp, Homo sapiens
  misc_feature 13, 44, 108: n = A,T,C or G
accatcgaaaggngcaagagcaagatcaccgggacatccgaggngcctttctccaaaaggtatttgaaatatctcaccaaaaaatatttgaagaagaataatctacgngactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccc

SEQ ID NO: 54661 - DNA, 260 bp, Homo sapiens
  misc_feature 12, 64, 91, 93, 131, 133, 155, 225: n = A,T,C or G
aagcagccggtngacttaggtctgttagaggaagacgacgagtttgaagaggtccctgccgaanactgggctggcttaaatgaagatgaanangcacatgtctgggaggataattgggatgatgacaatgncnaggatgaccttctctaatcagntacgagctgaactagagaaacatggttataagatggagacttcatagcatccagaagaagtgttgaagtnacctaaacttgacctgcttaatacattctagggca

SEQ ID NO: 54662 - DNA, 302 bp, Homo sapiens
ctcggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaacaaaaaaaaaaaaaaaaaaaaaaaaaa

SEQ ID NO: 54663 - DNA, 350 bp, Homo sapiens
  misc_feature 2: n = A,T,C or G
anccctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgacttt

SEQ ID NO: 54664 - DNA, 255 bp, Homo sapiens
  misc_feature 17, 31, 32, 60, 79, 93, 138, 147, 172, 216, 224, 245, 253: n = A,T,C or G
atttttttttgcagtgnctctctattgaacnncatgagtcacgatgatgtatcatgagtngtatttccatttgcggtgntacgtttctgttgntccatccatatattttgaaattgattctaccatgagatagctgtnacaactctntgtgtttagaggcaggtttaactgntcataccaggaaggaggtcatgataataacttcatgattaaatnatgctgtngccaactgagcaaccttaatnccctggangg

SEQ ID NO: 54665 - DNA, 400 bp, Homo sapiens
tagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctggtgacagaactcactcctctgtcctatgaagaccgctgccattggtgttg

SEQ ID NO: 54666 - DNA, 180 bp, Homo sapiens
  misc_feature 13, 41: n = A,T,C or G
agaaatcagtcanttacaagagtaattgtataagttattgntacctatagtgtgtggcttagatgaaagggagagtaaattttcataccatgctctctcctactcagtttgatctctctaaaattgtagtttggtttgatttaatataattcttagtagaaattttgaaagtatgctttg

SEQ ID NO: 54667 - DNA, 231 bp, Homo sapiens
  misc_feature 20, 21, 40, 44, 50, 53, 60: n = A,T,C or G
aatgagccaacggggaggannccagagcctgaatcagtgngtgnggttanttnaagcgtntggaaaggcgtgcgatacagggtgacagccccgtacacaaaaatgcacatattgtgagctcgatgagtagggcgggacaccgtggtatcctgtctgaatatggggggaccatcctccaaggctaaatactcctgactgaccgatagtgaaccagtaccgtgagggaaaggc

SEQ ID NO: 54668 - DNA, 300 bp, Homo sapiens
  misc_feature 25, 48, 252: n = A,T,C or G
taagaagcatcctctgccaagaccnaaaggaaagaagaaaaagggccnaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagcttgacctgacacagattgatgtcaatgtccaggatcatttctgggatgggaagggatngtgagatgatctgttactgcaacttcagcgaattgctctgctgcccaa

SEQ ID NO: 54669 - DNA, 300 bp, Homo sapiens
cagcctcatagtttttttagtaaagaagcaaaattaaaaggcttttaaaaatgtacaacttcagaattataatctgctagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggctttaaatcacaagaatatgtat

SEQ ID NO: 54670 - DNA, 240 bp, Homo sapiens
  misc_feature 49, 206: n = A,T,C or G
gcatgcaagtttgctgagctgaaggaaaagattgatcgccgttctggcnaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggggggtgncatcaaagcagtggacaagaaggctgctggagct

SEQ ID NO: 54671 - DNA, 480 bp, Homo sapiens
gtcaacagtacggagtaaaaaatcaaaacctctacaggaaaacggaaagtggtgtgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttgg

SEQ ID NO: 54672 - DNA, 390 bp, Homo sapiens
  misc_feature 27: n = A,T,C or G
tcttccggtggcggagcggcggattanccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccaggatggcttcacctgaaacctgcttttgtaaattacttttttttactgttgctggaagtgtcccacctgctgctcataataaatgcag

SEQ ID NO: 54673 - DNA, 390 bp, Homo sapiens
aatgaaaaggtttgattgcttttttgtgtttaaattacatataggtgttaaagtattaagggtaatcaccacaggaatagagagaaaatgcaaaatgttcaaacaagtagaagggaaatatggtaccaaaaaaacccaaaacaaaataaatgaactttcaaaacaaattaaatagctgttagtaaagctgtcataaaggaagtaaagaaatagcctgatgaaaagaaaatatgaaataaaatatataacatattttaattattttagccaaatattttaataattgcaatgaatataagtagactacctattaaaggccaaaaattataaaattagataaaattctagctattcaatattggcaagaaaaatacataaattaatgataca

SEQ ID NO: 54674 - DNA, 260 bp, Homo sapiens
  misc_feature 240: n = A,T,C or G
ccaatccagtcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtaaagcttagatttccctattgtgacagagccatggtgtgtttgtaataataaaaccaaagaaacntaaaaaaaaaaaaaaaaaaa

SEQ ID NO: 54675 - DNA, 300 bp, Homo sapiens
  misc_feature 48, 94, 205, 206: n = A,T,C or G
atttgtaactggctaaattttaaagtcgtgacaaataattacttaggntcagaaatatacacacacttactctttagccagtttctttcaaggnttactgtcccatcagatatctagccattttcctttgcaaattacataccttcttaagagtgtatttttaagattattacttacgctttatgatgatatagtttttcaaaannatttatagcttcatatgatggtttgtaattttttctattgatacctgttttaaaaatattttccaaggaagttgattaaaattatatttgttac

SEQ ID NO: 54676 - DNA, 320 bp, Homo sapiens
  misc_feature 12, 57: n = A,T,C or G
agtctcgcgagnagtgctcaggcgctcttcgtggctgccctcttagctactagcggngctcctcagggggcggccgggagcctacaattcctagaaagaaaatacgccattccggaaacagaactgcagttaagaccctcgaaaagatctaagaaagtgtgcatcctaaaacacctgacgaatttcagaatgtgacaaagcgcagaggatgcattatttcaaaacaaaacagaaggctaaaatttgcaggaaaaagaaaatcagtaaaccgggaatcctcggactggattgtaagcaaagatttgaatgaataagaagct

SEQ ID NO: 54677 - DNA, 370 bp, Homo sapiens
  misc_feature 36, 195: n = A,T,C or G
cttcctaagaccggcgctcggcaagttctcccaggnataaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaanattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagcc

SEQ ID NO: 54678 - DNA, 300 bp, Homo sapiens
cgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcatttttaagtgttcattcttttaagatttaatgcttgctttttctttttatagctaatagtg

SEQ ID NO: 54679 - DNA, 280 bp, Homo sapiens
  misc_feature 175: n = A,T,C or G
ccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaanccgaatatacagccttaaaatagaatgtggacctaaatacccagaagcacccccctttgtaagatttgtaacaaaaattaatatgaatggagtaaatagttctaa

SEQ ID NO: 54680 - DNA, 300 bp, Homo sapiens
  misc_feature 297: n = A,T,C or G
caagatgtgtgacttcaccgaagaccgaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtccgaaggacttcgggtgtttgacangga

SEQ ID NO: 54681 - DNA, 230 bp, Homo sapiens
  misc_feature 129, 131, 198, 217, 228: n = A,T,C or G
tattaaaataaaattatcaggaatactgcctcagttattgaacttttttttttaagaatactttttttttaagctgagaagtatagggatgaaaaagatgttatattgggtttgactattttccaactngnattttcatataatttatattttttaaaagctgaaaatttagaagtaagatgaaaaaaaggaaaagcnggggctttttaaaaatcanaactgaggtanct

SEQ ID NO: 54682 - DNA, 310 bp, Homo sapiens
  misc_feature 27, 204, 207: n = A,T,C or G
ctctttcccatcttgcaagatggcggntgaaaaagttgagaagccagatactagaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccntgnattccagaaaggccatgtacaagaggaagtactcagccgctaaatccaaggttgaaaagaaaaagaaggagaaggttctcgcaactgttacaaaaccagttgg

SEQ ID NO: 54683 - DNA, 180 bp, Homo sapiens
aattgaataaagcattatcttcttcgttgtttgcaatttcttgacaatctgcatgttctgcagtgttatcatgaacatttattttgtgttttaggcagtttctcttagtgttcagcaggaaacatccaatttaggtcctggatctgcaccatcccaaaaaaaaaaaaaaaaaaaaaaaaa

SEQ ID NO: 54684 - DNA, 229 bp, Homo sapiens
  misc_feature 53, 54, 56, 101, 203: n = A,T,C or G
gaccttgtctaggtgaacatctcagtgacatgctaatctgtttttaacagctnntncaacactagcctctctctgtctctaaccatgagcaggccccaggngtaaaccagcaccattatccagatagagttaaacattgggttatgttcattatcttatgatatatggcaattgatcctgaccctgtttttttatttaagggnaaaatatatttcttaatctagcttcc

SEQ ID NO: 54685 - DNA, 434 bp, Homo sapiens
  misc_feature 9: n = A,T,C or G
attctaagnatttggtttgggatcaataggaaagcatatgcagccaaccaagatgcgaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaaaaaaa

SEQ ID NO: 54686 - DNA, 400 bp, Homo sapiens
  misc_feature 49, 50, 56: n = A,T,C or G
acagtgtggtcaggcggctcggactgagcaggactttccttatcccagnngattgngcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgaccc

SEQ ID NO: 54687 - DNA, 350 bp, Homo sapiens
cctcgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggag

SEQ ID NO: 54688 - DNA, 238 bp, Homo sapiens
  misc_feature 53, 54: n = A,T,C or G
acctgtgttgtagaacatgagggtgtaagccttcagcctggcaagttacatgnngaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaaaaaaaaaaaaaaaaaaaaaaaaaa

SEQ ID NO: 54689 - DNA, 150 bp, Homo sapiens
  misc_feature 10: n = A,T,C or G
tgcttttgtncactagcatagagaatgtgttgaaatttaactttgtaagcttgtatgtggttgttgatcttttttttccttacagacacccataataaaatatcatattaaaattaaaaaaaaaaaaaaaaaaaaaaaaaaaaaaaaaaa

SEQ ID NO: 54690 - DNA, 440 bp, Homo sapiens
tgaagcatagagcagaagaaaattagaatttaaaataacataaaaataaaagaaaattagaattgacaggaaagcaagaatgcagggtccctaggagagctgctgcagtgagaatggaaagctgagataagggaatgttaaacattgtccttgccctccttgcagcttaggtttggttgaagtgaaaggcatgtgcagaaaataaagaataggactattcaataaagtggtcatttatgaatatagagttggtattctatcttggtatggtatggtaaatctggtatggttggtatggtaaatctctctatagcaaagagtagcagttaggctctgagtctctgcaccgatagaactgaacctgtatattggcttcagacttatcaagagactctggagaggttagttaaccacgtaaatcttgattactctgtctgtaa

SEQ ID NO: 54691 - DNA, 249 bp, Homo sapiens
tgcccagggtattggcaagcttgccgtgtacctgctggtggggctgtagccgtctctgctgccccaggctctgcagcccctgctgctggttctgcccctgctgcagcagaggagaagaaagatgagaagaaggaggagtctgaagagtcagatgatgacatggggtttggcctttttgattaaattcctgctcccctgcaaataaagcctttttacacatctgaaaaaaaaaaaaaaaaaaaaaaaaaa

SEQ ID NO: 54692 - DNA, 440 bp, Homo sapiens
  misc_feature 9, 10: n = A,T,C or G
tcccccaannaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagttagaaagagattgttaagaagggtattcatgtgtctttgctctttctgctttatgcctcagtttggtttaaaaacttctgtactggcaa

SEQ ID NO: 54693 - DNA, 480 bp, Homo sapiens
  misc_feature 3, 405: n = A,T,C or G
aanacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagntgttatttgtttacagaccatttaattaatatttcctctgtttattcctcctctccctccattgcatggctcaca

SEQ ID NO: 54694 - DNA, 250 bp, Homo sapiens
  misc_feature 49, 52: n = A,T,C or G
agccattgaggcagccagcgcagggttttctgctgagggggcaggcggngcntgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgagggaaaaaaaaaaaaaaaaaaaaaaaa

SEQ ID NO: 54695 - DNA, 370 bp, Homo sapiens
actgtcaagagtctagataggcatctgaatgaagctttgagcttcttaaaatgcaaggtgggtgaaacacaggataccaggaagagaaaggatattgttcatatagttgtggcagtggccttgagaactgtcttgactagagatagattaggaatctgaattattcctgaacattgggttttcctttagtgtattctctttagctttccctgcccgtctctactcattagatataccagcaatttatgggccagttaggaaaacttcatgagattggattgtcctattaaaaaagcataatacattttcataaaatccttctttcgatgccctttttttttttaaagcacgtcagctaactgttcagatg

SEQ ID NO: 54696 - DNA, 178 bp, Homo sapiens
acaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactaaaaaaaaaaaaaaaaaaaaaaaaaaaaaa

SEQ ID NO: 54697 - DNA, 210 bp, Homo sapiens
atcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgccgcaaaaaaaaaaaaaaaaaaaaaa

SEQ ID NO: 54698 - DNA, 150 bp, Homo sapiens
  misc_feature 5, 77, 85, 121: n = A,T,C or G
aaggngaagtatgtgtgggcacatgttatggcagattgaaaaggatctcattccatgggaaaaaaaaaaaatcctgncttgttcntaaattgacaatgtcaataaattgaaatatggttcnctgttaaaaaaaaaaaaaaaaaaaaaaaa

SEQ ID NO: 54699 - DNA, 430 bp, Homo sapiens
catcccaattaagtttgttcgtggtagcatcttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggaggaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaac

SEQ ID NO: 54700 - DNA, 316 bp, Homo sapiens
  misc_feature 29: n = A,T,C or G
cctgaaggcgagtgtgggcatagcattanctgcttcctcccctcctggcacccactgtggcctggcatcgcatcgtggtgtgtcaatgccacaaaatcgtgtgtccgtggaaccagtcctagccgcgtgtgacaagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcggaaaaaaaaaaaaaaa

SEQ ID NO: 54701 - DNA, 217 bp, Homo sapiens
aagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaaaaaaaaaaaaaaaaaaaaaaaaaaaaaa

SEQ ID NO: 54702 - DNA, 360 bp, Homo sapiens
  misc_feature 51, 102, 130, 155, 205, 207, 280: n = A,T,C or G
aggcgcagccgtgcgatgttgtcctctacagccatgtattcggctcctggnagagacttggggatggaaccgcacagagccgcgggcccctttgcagctgcnattttcgccctacgttttcaacggaggnactatactggcaattgctggagaanattttgcaattgttgcttctgatactcgattgagtgaagggttttcaatncntacgcgggatagccccaaatgttacaaatttaacagacaaaacagtcattggatgcagccggtttttcatggnagactgtcttacgctgacaaagattatttgaagcaagactaaagatgtataagcattccaataataaaggccatgactac

SEQ ID NO: 54703 - DNA, 410 bp, Homo sapiens
  misc_feature 5: n = A,T,C or G
atggnggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagat

SEQ ID NO: 54704 - DNA, 350 bp, Homo sapiens
ggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaagataaaaggtttctaaaacatgacggaggttgagatgaagcttcttcatggagtaaaaaatgtatttaaaagaaaattgagagaaaggactacagagccccgaattaataccaataaga

SEQ ID NO: 54705 - DNA, 400 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatggagcttcttcatggagtaaaaaatgtatttaaaagaaaattgagagaaaggactacagagccccgaattaataccaatagaagggcaatgcttttagattaaaatgaaggtgacttaaacagcttaaagt

SEQ ID NO: 54706 - DNA, 280 bp, Homo sapiens
ctgatcacttacatctcagtaccggcagtatacctctgtccaaacgaaaggagtacgtgaacaagaataattccatcagaatctgtccatattgtctgttttaaatagcatttctttaaaatgtcaaaaaagactccaatgagaaaataaccaatattgattacgtactccactttagggtgacttaagtgatcaagggtgtaaattccttagatagaactaactcgaaataaaaaactgttggggagaaggaagagccaaaaaaaaaaaaaaaaaaaaa

SEQ ID NO: 54707 - DNA, 390 bp, Homo sapiens
ccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagctggctgatgaataagatctaagagttacctggctacagaaagaagatgccagatgacacttaagacctacttgtgatatttaaatgatgcaataaaagacctattgatttggaccttcttctgaaaaaaaaaaaaaaaa

SEQ ID NO: 54708 - DNA, 200 bp, Homo sapiens
  misc_feature 79, 110, 140, 165, 189: n = A,T,C or G
agttacaagatgttgtttcggcaaagcattttgatggaatagggaactgcgaatgtatgatgattttgaaaaggctcancaggatttgttcttaaaccgactcagtgtgncatccccggttatttagaattacagttaanaaggagaaacttctataagactgtntgaacaaggggatatcttcatagngggctattaca

SEQ ID NO: 54709 - DNA, 390 bp, Homo sapiens
taggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttggaatgtaatttatttattag

SEQ ID NO: 54710 - DNA, 480 bp, Homo sapiens
  misc_feature 410: n = A,T,C or G
aacaagcatgtctctctgccaagatccatctaaactggagtgatgttagcagacccagcttagagttcttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgngatatttttaaatatccacagtactcactttttccaaatgatcctagtaatttgcctagaaatatctttc

SEQ ID NO: 54711 - DNA, 362 bp, Homo sapiens
atttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttgggttttccaaaaaaaaaaaaaaaaaaaaa

SEQ ID NO: 54712 - DNA, 284 bp, Homo sapiens
aaacatcctatatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaaaaaaaaaaaaaaaaaaaa

SEQ ID NO: 54713 - DNA, 410 bp, Homo sapiens
  misc_feature 49, 51, 57, 204, 205: n = A,T,C or G
agggatttatacatgaaaaatggacaaggatttgcattagtttattccntnacagcncagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcnngacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaa

SEQ ID NO: 54714 - DNA, 390 bp, Homo sapiens
  misc_feature 55: n = A,T,C or G
atagacattctcacataagcccagttcatcaccatttcctcctttacctttcagngcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtctcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaa

SEQ ID NO: 54715 - DNA, 100 bp, Homo sapiens
  misc_feature 17, 21, 39, 68, 72, 79: n = A,T,C or G
ttggatttgcttatcanacanaagaaaatgaaggacctnaaagcacctgaacagtgtatcgaccagancgantctatgntatcttcatttgaatggctgg

SEQ ID NO: 54716 - DNA, 400 bp, Homo sapiens
  misc_feature 287: n = A,T,C or G
aatgaaggtgaattcaaggctgaaggaaatagcaaattcacctacacagttctggaggatggttgcacgaaacacactggggaatggagcaaaacagtctttgaataccgaacacgcaaggctgtgagactacctattgtagatattgcaccctatgacattggtggtcctgatcaagaatttggtgtgggacgttggccctgtttgctttttataaaccaaactctatctgaaatcccaacaaaaaaaatttaactccatatgtgttcctcttgttctaatcttgncaaccagtgcaagtgacccgacaaaattccagttatttatttccaaaatgtttggaaacagtataatttgacaaaagaaaaatgatacttctctttttttgctggtccaccaa

SEQ ID NO: 54717 - DNA, 341 bp, Homo sapiens
  misc_feature 48, 52, 203, 207: n = A,T,C or G
acgacacatatacatatgagaatataccttatttatttttgtgtaggngggngccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccancagntgtatgtttgctgattatttatgacctgaaataatatatttcttcttctaagaagacattttgttacataaggatgacttttttatacaatggaataaattatggcatttctattggcaaaaaaaaaaaaaaaa

SEQ ID NO: 54718 - DNA, 500 bp, Homo sapiens
  misc_feature 14: n = A,T,C or G
gtgctttgcacagnaaagttagttaaacggtatcaagaaaaatgggacaaattgcttttaacatcaacagaaaagtctcatgtagatttatttccaaaggacagtattatctatttaactgctgattctcccaatgttatgactactttcaggcatgacaaagtttatgtaattgggtcttttgttgataagagtatgcagccaggcacatccctagccaaggcagaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtg

SEQ ID NO: 54719 - DNA, 175 bp, Homo sapiens
aaatgagtatatgtaacagtttaaaaaaaaaagttggtattttataagcacagacaattctaatggtaacttttgtagtcttatgaatagacataaattgtaatttgggaacataaaaactactgaataaatcatgtggcctaatattgaaaaaaaaaaaaaaaaaaaaaaaaaa

SEQ ID NO: 54720 - DNA, 400 bp, Homo sapiens
  misc_feature 318, 348, 378: n = A,T,C or G
gaagttatttttagaaatgataggtaaccaggtccaatcagtaaaaataagctgcttataactggaaatggccattgagctgtttcctcacaattggcgagatcccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaanttcaactggaaattaaaaaaaaaaaactanactccattgggccttactaaatatgggaangtctaacttaaatagctttgag

SEQ ID NO: 54721 - DNA, 270 bp, Homo sapiens
tgcagtgattcatgcctataatcccaagcactttgggaggccaaggcaggtggatcaccacgtcagaagatcgagaccatcctggtcaacatggtgaaaccccatctctactaaaaatacaaaaattagctgggcatggtggcgtgtgccaagtaatccaagctactcaggaggctgaggcaagagaatcacttgaaccaggcagtcggaggttgcagtgagccgagattgcgccactgcactgtagcctggcgacagagtgaaactcca

SEQ ID NO: 54722 - DNA, 471 bp, Homo sapiens
aagggcgtctgttactgatcatggaaacaaaaaataaaataaaataaaattttttacttttggcaagttcttattgcagtagaatcatatgctgaatggtacccctgagattttttttcagcatatatgttctaataggtacccagccaattttgacttgcaagggaaagatacttcaaattggctgcatgttagaagacatgaatcccaaacaaatctgtgtgcagaaaataccattcaatttgctaggtcttgctaatgaagagagccttaaaaaacaaaccaacaacaacaacaacaaaaaacagcaacttggtacacctaagtgtggtaaaccctgtgttccacctagggtgaagtttatcttcctagagcaagggtgtccctcagtgatcacaacacagatgattttaaagtttcagctagtaatgttaatgagaaaagctggccagttttaaaaaaaaaaaaaaa

SEQ ID NO: 54723 - DNA, 490 bp, Homo sapiens
  misc_feature 19, 33, 37, 55, 60, 62: n = A,T,C or G
gacagtgaaagagtccctnttatggaggagaanaggngaacagagcatttcctgnctacnancactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatggctttagagcaccctccttcattacttttgcaaaaacatactgactcagggctctttttttctttttgcatatgacaactgttactagaaatacaggctactgggtttgcatagatcattcatcttaattt

SEQ ID NO: 54724 - DNA, 130 bp, Homo sapiens
  misc_feature 14, 33, 49, 93: n = A,T,C or G
ccaaagtggatgangtgaagtccacaatcaagntccaaatgaagaaggngttatggctggctgtagctgatggtcacgtgaagatgacagacnatgagcttgtgtataacattcacctggctgccaactt

SEQ ID NO: 54725 - DNA, 510 bp, Homo sapiens
  misc_feature 2, 18: n = A,T,C or G
anagcagagagagaatanttaggttaataacatcaggaatggaggggacattgctgctgaaattaaaagatttaaagaaatgtagtagtaacgacttatctgtgggagatatgttccaaaatcccaagtggatgcttgaaaccacagataatattgaactcttcatatactatattttttccttattatacatacccgtgatagatttatcaatttcgctcagcatgagattaacaataactaataaaaacagaataattatagaaatatactataacaaaaatatgcaaatgtagtctgtttctctctctcaaaatatcttattgtactgtacttgcctttattcttcttgtgataatgcaagatgatgagctgcctacccactgagagaaaatgaggtgaatgacttgtgtgttgtggcatagtgttaggctactacagatcctctggtaatgttagaaggaccatgtgctttgggttatctcagatcactgagccacgacaatatca

SEQ ID NO: 54726 - DNA, 383 bp, Homo sapiens
tcagaaaggacactctggacttcagccaacaggattcctgagctgaaatgcagatgaccacattcaaggaagaactttctgccccggctttgcaggatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatggcagcgcctcatcttcaacttttgtgctcccctttgcctaaaccgtatggcctcccgtgcatctgtattcaccctgtatgacaaacacattacattattaaatgtttctcaaagatggagctaaaaaaaaaaaaaaaaaa

SEQ ID NO: 54727 - DNA, 154 bp, Homo sapiens
  misc_feature 72: n = A,T,C or G
tcaaaataatgtaaatctttaaaaatataaattagaatgacaagtgggaatcataaattaaacgttaatggnttcttatgctctttttaaatatagaaatatcatgttaaagaaaaaaaaaaaaaaaaaaaaaaaaaaaaaaaaaaaaaaaaaa

SEQ ID NO: 54728 - DNA, 400 bp, Homo sapiens
agactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagcctgttggttatttgtcataaatgaacacccatcactatatgctatgttgaggggaggcaagtctgatcttcga

SEQ ID NO: 54729 - DNA, 400 bp, Homo sapiens
taagaaatgcaaagatgaatcagtcaaggatccttggtggatgatagaggaggttgaaatgaaagagaatgaatgaaatatgaaagtggaatagagtttgaagaaaggcaaacaacctatcattctaacaagtgtatttgaaatgaaaaagacctcacagatggttgaaaacgttgtttcaaactattcaccggactccaagtatgttcaagcaccctccagatagtaccattgacttttatttgttttatattattaagttccactggttaaaattgtttgagttaaagatttctgctgctaagcaaaacttaaaaaccattcttctattccagctccttaattttatggatgaggcaatttagactctaaatagtgacctggctaaaacagatattaa

SEQ ID NO: 54730 - DNA, 400 bp, Homo sapiens
catctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataattggtggtctgaacaaggcacctgtaaataaatcagcatttatgaccagaagaaaaataatctgg

SEQ ID NO: 54731 - DNA, 200 bp, Homo sapiens
  misc_feature 13: n = A,T,C or G
aattcctttgatngatgaccttgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataaaaaaaaaaaaaaaaaaaaaaaaa

SEQ ID NO: 54732 - DNA, 248 bp, Homo sapiens
ggaaatatgacaaagatctgtatgatttttgagattaatagaaatttgttagtaatgaccaaagttcccagggctactgataggggatatacatcgttaagtagagacttaagctattactttcttagtataccttaggttgaagacttcaagaagggcactaagaggctaaatgatcttaaggtagtgggaaattgggctttatatctttattttatacccaaaaaaaaaaaaaaaaaaaaaaaaaa

SEQ ID NO: 54733 - DNA, 320 bp, Homo sapiens
atcctaagcaaattaacgtaagaacagtaaaaccaaataccacattctctcagttataagtgggagctaaacattgaatacaccatagacataaagatgggaacaacaaaccctggggactattagatggggaagggaaggaggggagcatgggctgaaaaactaaccattgggtatgctcaccacctgggtgacaggaccatccgtatctcaaacctcagcatcatgcaatatacccatgtaacaaccctacacttgtattccctgaatcaaaaagttttaaaaatagaatatgaaaaaaaaaaaaaaaaaaaaaaaaa

SEQ ID NO: 54734 - DNA, 500 bp, Homo sapiens
  misc_feature 2, 30, 463: n = A,T,C or G
cngggctggcatgagaagtgacatctgcgntacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacctttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggnttgactataattctctgttatctttacgaggtaaaac

SEQ ID NO: 54735 - DNA, 330 bp, Homo sapiens
atgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacctaaaaaaaaaaaaaaaaaaaa

SEQ ID NO: 54736 - DNA, 310 bp, Homo sapiens
  misc_feature 20, 286: n = A,T,C or G
aaatcattgatgaccacagnagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatgggccnaaaaaaaaaaaaaaaaaaaaaaaa

SEQ ID NO: 54737 - DNA, 300 bp, Homo sapiens
  misc_feature 120, 140, 148, 172, 179, 188, 198, 235, 299: n = A,T,C or G
tatagaagttgtgtaaaatcagtatgaaagttcaatgttgctgttcttgctcagtgattttaaagaaattgagtagttcctatgtgatttttttttttcttttctaaactgcattcctgngcccacctacggcatgcctntatgtatnggctactacagggttttaaaaagngtttcanatatttctntaattatgtncaacctaaaatgttggggttttgtatggatcacaagngcagcattccttaattccttctgctatatgtcacacagttgttatttggagaaccaagtatgtnt

SEQ ID NO: 54738 - DNA, 393 bp, Homo sapiens
atgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaaaa

SEQ ID NO: 54739 - DNA, 300 bp, Homo sapiens
  misc_feature 294, 296: n = A,T,C or G
attggaaaaaataataataaaacaaagtcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggngnacat

SEQ ID NO: 54740 - DNA, 389 bp, Homo sapiens
cacttggcattagctaaaaccttcctatcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgaaaaaaaaaaa

SEQ ID NO: 54741 - DNA, 400 bp, Homo sapiens
ctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaa

SEQ ID NO: 54742 - DNA, 150 bp, Homo sapiens
atactaaggaaatttatcagggttaaagattcctgtaattaggcatgttttgatgttattgatatcctcttttctggttttggagtggatactttccctgctgtgacctctgtgctctgtagtggttctcctagggaattatattccagt

SEQ ID NO: 54743 - DNA, 500 bp, Homo sapiens
  misc_feature 4: n = A,T,C or G
tatntgattcgatttttagtacgcacattttgttcacgggcacttaaaaataccaacaatactgaaagatgacctactaagttctttgaacacataatgggcagtgaaactcactaccaaccatcccctcctaacttgacacggcaaatgtcaacaatttttcaggtgcccattttagccaaccatgactacacctcaggaaaaaacaccagaacttctcgctctcagttttctaaattacctcgcttcactaagattagccttcagctagtcaacgacatccttcaatctatgagctgtgagggcaaaaatataatacagcagctattaaaatgaaactattttctctctcaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatc

SEQ ID NO: 54744 - DNA, 500 bp, Homo sapiens
aactgaaattcgaatggcgaggtatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagat

SEQ ID NO: 54745 - DNA, 340 bp, Homo sapiens
acctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtata

SEQ ID NO: 54746 - DNA, 230 bp, Homo sapiens
catcagtagcatctgtaacagcattaactgtcttaaagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgt

SEQ ID NO: 54747 - DNA, 280 bp, Homo sapiens
  misc_feature 219: n = A,T,C or G
aataatgcatttaaatttgggatttgggtggagtattatgtttaactggagttgtcaagtatgagtccctcaggaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatncatttagtaaagcccccaagacattagtcttacatttaaacttttttctttaaaacatggt

SEQ ID NO: 54748 - DNA, 460 bp, Homo sapiens
  misc_feature 419: n = A,T,C or G
caacagcatctctgctgttgacaatggctctctggccaacacgcctcatccgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgnggggattgttttacccacatgacttattatgcataaagcca

SEQ ID NO: 54749 - DNA, 280 bp, Homo sapiens
  misc_feature 184: n = A,T,C or G
taactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgnacaaaactttttatatcaaaaggctttgcacatttctatatgagtgggtttactggtaaattatgttattttttacaactaattttgtactctcag

SEQ ID NO: 54750 - DNA, 257 bp, Homo sapiens
  misc_feature 42: n = A,T,C or G
agaagggtttttttagaaatacatttagtaaagtccccaagnacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaaaaaaaaaaaaaaaaaaaaaaaaaaaaaaa

SEQ ID NO: 54751 - DNA, 430 bp, Homo sapiens
acagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaacccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggat

SEQ ID NO: 54752 - DNA, 500 bp, Homo sapiens
agaccaaagccgtgatcccaaccttagcaacataattctactggaggtgttgatatatatactaatccagaacaaccatgtagcaagaggaataaaatgaagttcagaagtctgtttcgggaaattttgaagccctttagaaagaaagatttctacattttgttacatgaaattcatgcaaatatatgtcaggtgccagtgctatggagttgttgaagaataagcacaataccatttattaccacttctcagttgtaaagaggctgtaactctggttgtcgaaataaaataaaatgaaatctcctagatgtgacactgtgacccctgccagttatttacaaacaagttatctgcacattttgggctgtaaacataaaagtaaactctctgaaagactgcaaatcatctttagggttttcttaaagtaaatacaactagtggcccaggaaccaaaagtttgcttgtttccagttaatgtcactggtcaccataactcaccc

SEQ ID NO: 54753 - DNA, 197 bp, Homo sapiens
  misc_feature 1, 3: n = A,T,C or G
ncnccagcttagcgaacatggtgaaaccccgtctctaccaaaaataaaaaaattagctgggcgtggtggcaggcacctgtagttccagctactcaggaggctgagacacaagaattgcttgaacccaggaggtggaggttgcagtgagccaagatagcaccatcacactccagcttgggcaacaaagcaagactccg

SEQ ID NO: 54754 - DNA, 370 bp, Homo sapiens
agatacagccatccccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatggtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaag

SEQ ID NO: 54755 - DNA, 350 bp, Homo sapiens
  misc_feature 3, 285: n = A,T,C or G
acnccagtaataggagcagtttacggtaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggcngtggacttcacttgggaggagtggcaactcctgggcgctgctcagaaggacctgtaccgggacgt

SEQ ID NO: 54756 - DNA, 450 bp, Homo sapiens
  misc_feature 356: n = A,T,C or G
ccgccgccattttgatggcaggaagtagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggnttttggattgtcaccctcaatgggactgcttcacagaagaaaagcctggttcataaaactttgcctgatgttctagcagaacctttatcaagtg

SEQ ID NO: 54757 - DNA, 296 bp, Homo sapiens
  misc_feature 225, 228, 245, 267, 274: n = A,T,C or G
aaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcangtntcccaaccccaaacctnggttctgcttcaataaatcttnggaaaanctctaaaaaaaaaaaaaaaaaa

SEQ ID NO: 54758 - DNA, 340 bp, Homo sapiens
taggtgtgtgagtcttagggctgagcaagagctgggatgcttagttctaatgtggggttggaccagaatcacatctacataggtcatagacctgaattccagtgaaaaccaataaagaaatgggaattttgtttgaaataatgaattattatataatccatagtcttcttacaggagttagatcaaaaagtactgactacacatagaagtcttaactttgcttcaaaagcataaggtagaattgaaagatttagaatggagtcatttcttttacctaatagctgatctcagattcctccttggtcaagatataatttatttaaaaaaaaaaaaaaaaaaa

SEQ ID NO: 54759 - DNA, 400 bp, Homo sapiens
  misc_feature 54: n = A,T,C or G
tttgctaaaggtaaaaatcgctacttatggggcttttgtcatacttcttaaccnaacttccctaacttctgaggataaaaaccataagggcaatcttattcttccaaagcagttccctggtgccactttcagaaacagagtattgaactatgggtctgacccagtgtggcactgagtgtgtgtgtgtttgtgtgtttgtgtgtgtgtgtacactgaataagccaaaacgtgcgccatattctaggtttctgctttacttaactggcaaaatttggtgctgtaagggaggcagccacaaaaccagtgatagcatttgttagtatcatcttagttctcttccctcccctaggtagtttataaagggtgatttctgaaacccttcacaaaagaaaagctcaag

SEQ ID NO: 54760 - DNA, 283 bp, Homo sapiens
  misc_feature 119: n = A,T,C or G
atctaaattaaaaaagaaagaaatttgaaaaaactttctctttgccatttcttcttcttcttttttaactgaaagctgaatccttccatttcttctgcacatctacttgcttaaattgngggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaaaaaaaaaaaaaaaaaa

SEQ ID NO: 54761 - DNA, 470 bp, Homo sapiens
atttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaataggttttgtatatttctcttttgatcttaaagattgtatcttattgaatatcccactgtatattatttttatatgtaaaaagataagtttaatactgtatcagggtttaacttttactatttcagatcttccacagcttgtaatttcatcaagggaatccttttgcattgttaatttgttggggggggagtccaccaatgaagtggtatgtgaaaaatttcaaacttgctttataatagattga

SEQ ID NO: 54762 - DNA, 294 bp, Homo sapiens
  misc_feature 17, 106, 191: n = A,T,C or G
gcaaaagtagaagtatnaaataaaaagggcaacttttaaaatattaagcctgaagacttctaaaaagacaaggaaacatggcctaaataaccaacatagatttacntagtaagtttcacactaccttattaccaaaagcaaacacctcttactttaaactacattatcatgtatatctattgtatgctggnctttactttttgccaaaatcaacatataatgaagagatgcctttgtttcatgagattcaaacttgatgctatgctttaaaataaactcagtacttttagaaac

SEQ ID NO: 54763 - DNA, 430 bp, Homo sapiens
  misc_feature 21, 77: n = A,T,C or G
attaaagatctgctgcctagnactcacccccatcttaaagaacagacatgaaaaagtacaagagaattgtattgatncttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtt

SEQ ID NO: 54764 - DNA, 230 bp, Homo sapiens
ttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgagccaaaaaaaaaaaaaaa

SEQ ID NO: 54765 - DNA, 329 bp, Homo sapiens
  misc_feature 14, 20, 31: n = A,T,C or G
caaaggcggaaaangcttgnggaagggtggngctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggtctcctgagaacttc

SEQ ID NO: 54766 - DNA, 600 bp, Homo sapiens
  misc_feature 352, 362: n = A,T,C or G
ataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttatttggtttggagactagagccaatagtataatgttctcaaaggaaacagacttgagttgttggattagaggaactaacccaacttatatgattttttttttgntttttgtcgngtaggttatggcacctgtcttatttggaacatttgcaactagggataatacaacatttttaactctcatttgacaacctactactaatcacagaccacaagggtaatgaccaaatttatgtgggtttttgcactccatagttgtcttagcccaatctttctatactcttacgattacttgggttaacgcttctgtgaggaccttctggctcttgagataccctaaatatttaagatat

SEQ ID NO: 54767 - DNA, 138 bp, Homo sapiens
aactgcaatttggttccaccacatcctgactactaccgtatagttttctctattctttcatttcccccttccccattcctttattgaacataaagtaactggtatatgtgcacaagcatattgcattttttttttttt

SEQ ID NO: 54768 - DNA, 560 bp, Homo sapiens
  misc_feature 11, 359: n = A,T,C or G
caagcataagncgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgtntgtagataaactcctctatccagcagacacacctgttggaaatgatcaactgctggaaatacttaataaattaatcaaatacatccaaattaagtttgttccgtggtagcaccttcaaagaaatccccgtgactgtctataagccaattattaaaaaatacaccaaaatcattgatgggagtgcctgtgggaaataactgg

SEQ ID NO: 54769 - DNA, 200 bp, Homo sapiens
aatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaaaaaaaaaaaaaaaaaaaaaa

SEQ ID NO: 54770 - DNA, 337 bp, Homo sapiens
tttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaaaaaaaaaaaaaaaaaaaaaaaaa

SEQ ID NO: 54771 - DNA, 490 bp, Homo sapiens
tattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattgggtggtcctgatcaa

SEQ ID NO: 54772 - DNA, 320 bp, Homo sapiens
cttatagaaacacattttgaggccgggtacagtggctcacacctgtaatcccagcactttaggagaccaaggtgggcagatcgcttgagcccaggcattcaaggccagtgttggcagaatggcgaaaccctatctccacaaaaaaatacaaaaattagataggcgtggtggcatgcatctatagtcccagctacttgggaggctgaggtgggaaaatcacttgagcctgggagacgggctgcagtgagccacaattgcagcaccgcactccagcctgggcgttggagtgagaccctgactcaaaaaaaaaaaaaaaaaaa

SEQ ID NO: 54773 - DNA, 119 bp, Homo sapiens
  misc_feature 7: n = A,T,C or G
ttgaacntagcagatggacaggagtatcacacgaaacttctcagcatcacgatgaccttgaataaaaattgcacacattcagtgcagcaatatattaccagcaaaaaaaaaaaaaaaaa

SEQ ID NO: 54774 - DNA, 407 bp, Homo sapiens
tctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtgggatgttttacccacatgacttattatgcataaagccaaatttccagtttaagtaattgtctacaataaaaagaaattttgcctgcctaaaaaaaaaaaaaaaaaaaaaaaaaaa

SEQ ID NO: 54775 - DNA, 370 bp, Homo sapiens
  misc_feature 297: n = A,T,C or G
tatctagagctagtttctggtgaattattctttattttgtactgttgttaggcagctctgtagttgctaatttaaccaataagtcaatttctattcatgaagaaacgattctgagaatcctgtcaggaattggggaatgaaaaaatacacaaaataatggtctttgtcccagtagagttcatagtctatttagtgtgcattgtttttccttaatgatgtatttgatctgacttttttccttctcaaaagaatcatacttgggattacaggtacattttgatgttatatgatgggganaaagtgaaaaagtttttaaagggagattttatacctttttcacattaaaaaagggatttatattattactttt

SEQ ID NO: 54776 - DNA, 500 bp, Homo sapiens
agccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgacattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaaagaaaggatcatggtt

SEQ ID NO: 54777 - DNA, 380 bp, Homo sapiens
  misc_feature 294, 336: n = A,T,C or G
aacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgntaactaaatgatctatattttactgatttaatattacagggnaaagaatgtcagtcattgggtaggttcttgggctagttttcatt

SEQ ID NO: 54778 - DNA, 560 bp, Homo sapiens
  misc_feature 14: n = A,T,C or G
cacccatacacatnccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatact

SEQ ID NO: 54779 - DNA, 440 bp, Homo sapiens
agttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttatttgacttggtagtaactgccaccaataaagcagtctttaccatgtaaaaaaaaa

SEQ ID NO: 54780 - DNA, 347 bp, Homo sapiens
actacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcaaaaaaaaaaa

SEQ ID NO: 54781 - DNA, 340 bp, Homo sapiens
cagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgta

SEQ ID NO: 54782 - DNA, 229 bp, Homo sapiens
ctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaa

SEQ ID NO: 54783 - DNA, 386 bp, Homo sapiens
ctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaagacgcccaaaaaaaaaaaaaaaaaaa

SEQ ID NO: 54784 - DNA, 250 bp, Homo sapiens
tgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttaaaaaaaaaaaaaaaaaaaaa

SEQ ID NO: 54785 - DNA, 166 bp, Homo sapiens
  misc_feature 21: n = A,T,C or G
atgccgaacactagactctgnatgtaatcgcccatgcattactggtaaagcctcatttgaatgtgtgaattcaatacaggctatgtaaaatttttactaatgtcattattttgaaaaaataaatttaaaaatacatttaaaaaaaaaaaaaaaaaaaaaaaaaaaa

SEQ ID NO: 54786 - DNA, 340 bp, Homo sapiens
acaccatcaacattcacaagtcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaaatctacagacagtcaatgtgggatgagaactaatcgctgatcgtcagatcaaataaagttataaa

SEQ ID NO: 54787 - DNA, 410 bp, Homo sapiens; identical to SEQ ID NO: 53667

SEQ ID NO: 54788 - DNA, 390 bp, Homo sapiens
aggccggaagcggtggtttttagcggctctctgggtagcagggtggtgtgatagcggcagcgaggggctcggagaggtgctcggattctcgtagctgtgccgggacttaaccaccaccatgtcgagcaaaaggacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaaagatttgcatgatatgcttgcttcattgggggaagaatccaactgatgagtatcttagatgccatgatgaatgaggctccaggccccatcaatttcaccatgttcctcaccatgtttgg

SEQ ID NO: 54789 - DNA, 326 bp, Homo sapiens
  misc_feature 18: n = A,T,C or G
tcgcaatagttttttacntctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattg

SEQ ID NO: 54790 - DNA, 430 bp, Homo sapiens
catggctgcaagaaagacctaaaattcagggcccgtgaacttcagatacgtaaaaggaatatcacttctgttctagaagagtactaattagacttgtttgtgaaatttgaaaatttggctttgagacactggtaacaaacatatctgagccctcctaagtttggtcagcacggagtagtagctctggtatcatgtggctgtgtagagctccagtgtgatttcaagccccctctaaaaactgccttagtctgcatgaagtagttaactctccaaagtgctttttgtctggcaaatcccttcacaattttcacctctcgtctaaaagcttccttaaaggaagccttccttgatcccttaggctaggttaaggtttccagtctgtgttctcatagcactctgcactttttggttccttaaagcaactctgtgt

SEQ ID NO: 54791 - DNA, 460 bp, Homo sapiens
  misc_feature 426: n = A,T,C or G
ggaattatctgaagccgaaaaccgtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaaagaagntaaaaactacaacctttaatgataaaattgacaa

SEQ ID NO: 54792 - DNA, 440 bp, Homo sapiens
taaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtattgatgggttttcttcttgagcaacatgattgagaaccagtgtatgtcaacaggtgcatttgagataactttaaatgatgtacctggtgtggtctaagctggaatctggtcaccttccatccatgcaacaacttgttcaaaat

SEQ ID NO: 54793 - DNA, 269 bp, Homo sapiens
aaagaaataatgctgaaaatctcccaaatgtaatgtaaatcattaatgcacacattcaagaagcccaaagaatccaagtcggaatactcagatccacatgcagacacatggtaataaaaacgctgaggcctggcatgttggcgcacacctgtaatccctgcactttgggaagccaagaaggggtggattgcttgagctcaggagttcaagaccagcctggggaatgtggcaaaaccccatctctttggaaaaaaaaaaaaaaaaaaaaa

SEQ ID NO: 54794 - DNA, 420 bp, Homo sapiens
  misc_feature 41, 170: n = A,T,C or G
atagcccagcaacctacagatgaagaaagttgagaaatccntttattcaccatagagacgcaggaatttcaggcaatgcactaaaatgaaatgggggaaaaaagcttgatcagtacaggaaccatttttgtgcaaaagggaatattatggatcagccagtatttctttgngctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtggggatctgtttccagttagatgccattattttccttttccttggtttactcttccacatattggtaaagctcttccaatagctttt

SEQ ID NO: 54795 - DNA, 460 bp, Homo sapiens
caattggtatgatttagctgcaaacctgcagacactgggttgatttttgtttatgattcctatgtgttcagatagtcatgtttttctgtactactttaaaaccactttgcatccccaaagccaaagttttaaaatttcaattacttatttaatttgaaaaaaaagactttgaaaagttttgaaaaaaatacatattagtgtttctttagaaaatgagttttaatttttaaatatttaaatattttgtgtttgttagattttgacacattaaactctgcaagaactcatttattgcataaaatgaaacacacatgcatacttgtcatacatgtatgtatttttatatgtacaactatctgtaatctagtaattatcgcatgtgatcttttatagctaattcatgaaaaataacaatgccaaataaaatattttattcacgttctcatttaaattgaatatt

SEQ ID NO: 54796 - DNA, 460 bp, Homo sapiens
  misc_feature 21: n = A,T,C or G
agggaaggggacgcgccggangaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagcctggattacacacagcaagttcctgcttctgggacagctctactgacgggagctgcactgtgcgatgggagaaataagaccatgtactgcatcgtcagtgccttcggactgtctatttgaccctgcagtccagcctatggcctttctccttttgtctctagttcatcctctaaccaccagccatgaattcagtgaactcttttctcattc

SEQ ID NO: 54797 - DNA, 399 bp, Homo sapiens
tgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatattttagatgtaccctgttaacagccag

SEQ ID NO: 54798 - DNA, 380 bp, Homo sapiens
tcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttcaaaatgtctcaatggtgctataataaataaacttcaacact

SEQ ID NO: 54799 - DNA, 289 bp, Homo sapiens
  misc_feature 16: n = A,T,C or G
taaatcaattgtatantactttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctaaaaaaaaaaaaaaaaaaaaaaaaaaaaa

SEQ ID NO: 54800 - DNA, 450 bp, Homo sapiens
  misc_feature 398, 431: n = A,T,C or G
ttcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaagcagcatnttgggaggttttgaagatgccgcatttggattnggatgaattccaaattctg

SEQ ID NO: 54801 - DNA, 119 bp, Homo sapiens
tttggaaatatttttttcctttgcattcatctctcaaacttagtttttatctttgaccaaccgaacatgaccaaaaaccaaaagtgcattcaaccttaccaaaaaaaaaaaaaaaaaaa

SEQ ID NO: 54802 - DNA, 410 bp, Homo sapiens
  misc_feature 370, 399: n = A,T,C or G
taaatcctaaacaggcaaaccaaacagcacactgtagccactagttgttactgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgctttggttttactattatgtaatcacaacttactttctgcttgtagttgcttaaaattatgtaatttttgtcttgggctgcaatttgntttatgcttattttattattactggcagnaagttgaccct

SEQ ID NO: 54803 - DNA, 145 bp, Homo sapiens
  misc_feature 98: n = A,T,C or G
aaatacactagtcaaattgtgcaatggaataaaatccacactttagattcttgcaactgtatcctactgtaatagtatcactttttctacattttggncaaataaatttttacataaactacaaaaaaaaaaaaaaaaaaaaaaa

SEQ ID NO: 54804 - DNA, 290 bp, Homo sapiens
  misc_feature 12, 22, 29, 67: n = A,T,C or G
ttagccagtgtnctttgaagtntgtaacnttttaaaatcttaagtgtcttgtattgattagaaatantgtgaatgagtaacttacttttgtatcaggaatgttttggtactgtgttttcacttcaaaccactgacttaacagatactgctgtgtataacatgtactaaatattacagttattgtgcataacagattgttcctcttatatttgtgtgtatacaggcaattcatgttttaatgtaaataaataccatttttgcagttaaaaaaaaaaaaaaaaaaaaaaaaa

SEQ ID NO: 54805 - DNA, 430 bp, Homo sapiens
  misc_feature 395: n = A,T,C or G
cagactctgtttactgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaagggggagtgtactagtgggatttggggaaagggttcnttaagtagatcctgagactatttgcatgcttctgt

SEQ ID NO: 54806 - DNA, 281 bp, Homo sapiens
  misc_feature 15: n = A,T,C or G
gttgctatcatgacnggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttt

SEQ ID NO: 54807 - DNA, 404 bp, Homo sapiens
ctacaactgtaaaataaatattcttaaagcaggcagtgatgatcaaaatcttgccctttgacccttaagctgctagaatactgagagtgataatttaggaatgagttgattaaagaaaataacaaagtagtttactaaggaattaataatagcaaataaaaggtttaacaaacaacaataaatattctgttgatattgcaccttaactttccatcatcatcttgggagctgacttttttgctgatttcattccgataagataagttcatttgaccacgtgattattatttaatacatctactgataactctataatagaaagtggcagattttagataaagggtttgtgatttttaaggttgatattaacaggtagtatcataaaaaaaaaaaaaaaaaaaaaa

SEQ ID NO: 54808 - DNA, 260 bp, Homo sapiens
  misc_feature 77: n = A,T,C or G
ctttttcgattccgccatctgcggtggagccgccaccaaaatgcagattttcgtgaaaacccttacggggaagaccntcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttc

SEQ ID NO: 54809 - DNA, 450 bp, Homo sapiens
  misc_feature 49, 52: n = A,T,C or G
ttgatggtaccaaggaagcagcagctgctttgattgacttggatctttntanaggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggaatattgtcttccactttccatcatgtatgtaaaatttcatagtaaaacttcctgatagtttcaataaagaaattatc

SEQ ID NO: 54810 - DNA, 400 bp, Homo sapiens
  misc_feature 3: n = A,T,C or G
acnctaaaagttctggctaactttggaatcccttagagaaaaatccttgtcaccagattctttacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattc

SEQ ID NO: 54811 - DNA, 160 bp, Homo sapiens
  misc_feature 30, 50: n = A,T,C or G
agccaaacactagctctgtattaatccccntccttactggtaaagcctcntttgaatgtgtgaattcaatacaggctactgtaaaatttttactaatgtcattattttgaaaaaataaatttaaaaatacatccaaaaaaaaaaaaaaaaaaaaaaaaaa

SEQ ID NO: 54812 - DNA, 100 bp, Homo sapiens
  misc_feature 24, 65, 79, 88, 91: n = A,T,C or G
agtatggcccttgacattgagatngccacctacaggaagctgctggaaggcgaggagagcagganttctctgcctcttncaaactttnccnccctgaacc

SEQ ID NO: 54813 - DNA, 450 bp, Homo sapiens
tttttgtccgacatcttgacgaggctgcggtgtctgctgctattctccgagcttcgcagtgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaagggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtgggagatgctccagctgctggtgaagatgcatgaataggtccaacc

SEQ ID NO: 54814 - DNA, 320 bp, Homo sapiens
agatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattgggagaagtatagaaaaaaaaaaaaaaaaaaaaa

SEQ ID NO: 54815 - DNA, 368 bp, Homo sapiens
  misc_feature 275, 298: n = A,T,C or G
tgaccaaaattttaagtaggaaagtcacccaaacacttctgctttcactttaagtgtctggcccgcaatactgtaggaacaagcatgatcttgttactgtgatattttaaatatccacagtactcacttttttccaaatgatcctagtaattgcctagaaatatctttctcttacctgttatttatcaatttttcccagtatttttatacggaaaaaattgtattgaaaacacttagtatgcagttgataagaggaatttggtataattatgggngggtgattatttttttatactgnatgtgccaaagctttactactgtggaaagacaactgttttaataaaagatttacattccaaaaaaaaaaa

SEQ ID NO: 54816 - DNA, 450 bp, Homo sapiens
  misc_feature 14: n = A,T,C or G
ctgttccagaagtnggactcattagacatcagaaaattcactcaggagagaaaccctataaatgcagtgactgtgggaaagccttccctacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaaatggtggcagggcagtgtgagtttgcccacatcctgcattcatgataaacagtttgctgtttgatcatatagcctccagcggaatgctggagtttgtcatgtcccatgggcctttggctccct

SEQ ID NO: 54817 - DNA, 320 bp, Homo sapiens
ccattcttgcttagacagtcagcatttgtctcctcctttaactgagtcatcatcttagtccaactaatgcagtcgatacaatgcgtagatagaaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgcaaaaaaaaaaaaaaaaaaaaaaaa

SEQ ID NO: 54818 - DNA, 135 bp, Homo sapiens
  misc_feature 20: n = A,T,C or G
tgtaagctgttcctctgganctcaccctctgttgagttgtaaatgtgagagaaaaaagttactatgtgaaatctactactcaagccagcattttgtatttttgcatcattaaaaaaaaaaaaaaaaaaaaaaaaa

SEQ ID NO: 54819 - DNA, 500 bp, Homo sapiens
  misc_feature 426: n = A,T,C or G
atgaggattaaataaatgtaaggtttttagaacattgatagggagcaataaatagaagattgtattattattctgttaccttggagtgtaagtactgcatttaagtgaatgaaaaatttgctttgaccaggtactgaaggaaataagtaatagctagtatttatccaatgccaactgtatgctaggtactgtgcttagataatctgtgtataatagtgttaatcctcaaaatttgggtgttatacccctattatagataaggaacctgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatataatgacgnctgatgcattggccagtaatagtcaaattaacccagccaaattgtcacagtgattcttaaactgtggttctcac

SEQ ID NO: 54820 - DNA, 511 bp, Homo sapiens
aaacacaagttaaacataataacaacaattaaaatgtttgattatataacttttttagcctttttactcaaccaaaagagaacatacatgtgttttcaaatacccaaaggacattaataaaagttgatcctgcaatagactacaagaataatcttagtgaaattgacagagtcaaaatcatatagtccatatcctatgactatgacagtagaaagattaaaaagtaataataaaaagataactaaatgccccttgaaattacattttgtaaatatctcttgagtcaaagaagatatcaaatttgaaatgatagattatttagaaaatgatggtgagaacactaaccctatggcaggcagcaaagctgtgctcaggaggaaacttacatgcttttattatttaaagaaatcatgaaatccagaaatcatgaaaataactgaagcacatttttcaacccatgggaacaagatagaataaaccataaaagggaaaactagtaagtagaaattca

SEQ ID NO: 54821 - DNA, 311 bp, Homo sapiens
acctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcact

SEQ ID NO: 54822 - DNA, 363 bp, Homo sapiens
  misc_feature 6: n = A,T,C or G
aaagangatgatgatatctgaaattcaccagctgagtttctctttcttctctaaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaaaaaaaaaaa

SEQ ID NO: 54823 - DNA, 310 bp, Homo sapiens
  misc_feature 66, 81: n = A,T,C or G
tttccctaatgctggggttgggaactacagcccaaggcccatatctggcctgctgcctgtttttantcaatcaagttttanttagaacacagccacacttcatttgtttgcatattgtttgtggctgctttcaccctatggtggcagaattgaatagctgcaacagggaccttatggtccacaaaaccaacagtatttattatctggcacttcacagaaaagtttgccaactcttgctctgatgaataaggagttgctacaactacaaatcaatatgaaaagaccgaaaaaaaaaaaaaaaaaaaaaaaa

SEQ ID NO: 54824 - DNA, 540 bp, Homo sapiens
actggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttccgtggtagcaccttcaaagaaatccccgtgactgtctataagccaattattaaaaaatacaccaaaatcattgatgggagtgcctgtggaaataactggaaaaagagacaccgagaagaacgaatcattacaggtcctgaaataaaatacacttaggat

SEQ ID NO: 54825 - DNA, 440 bp, Homo sapiens
tatttcttcctttcttaatctttatgccttatttagctcttgccaaactgcaggggctgagcaattggacaagataaagaaataaaagtgatccagatcctaaagaaagaagtaaaactatatctgcacatgacataatcttgtctatggaaaatcctaaggaatccacacacaaaaaaactactagagctaataagttcagcaaggttgcaagatataaaattggtatacaaaattgcagtggctaggacctccagcagaatgctgactataagtagtgatagtgggtattcttgtctcatcctcaatctcaggggtggtgggtgtggcatgtggagagttgtcaatattcaccatgaagtttgatggttgttataggatttttaatgtactcattaacatatattctcaagctgttaaaaagattttttttaattaca

SEQ ID NO: 54826 - DNA, 560 bp, Homo sapiens
  misc_feature 24, 53, 80, 516, 536: n = A,T,C or G
aattcctgtaagactgacagcatncgggccgaggatgtgctcgctccgtaggngcttagctgtgctcgcgctactctctntttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggntttaataatgttaacatggncatgatcttctttataattctact

SEQ ID NO: 54827 - DNA, 510 bp, Homo sapiens
  misc_feature 41: n = A,T,C or G
taggagcctctctccctactgctgctacacaagaccctganactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacccgattttgtatccccctgtagcagcattactgaaatacataggcttatatacaatgcttctttcctgtatattctcttgtctggctgcac

SEQ ID NO: 54828 - DNA, 332 bp, Homo sapiens
  misc_feature 20, 28: n = A,T,C or G
aaaccgattcctggccaagnaaacaaantcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttgaaaaaaaaaaaaaaaaaaaaaa

SEQ ID NO: 54829 - DNA, 234 bp, Homo sapiens
caatgtaatgaagactgaggaaagtaacaacaaagtgtgcagaatacactgtcagtaacttgagaaaggtcagtaggaaagggataagaagaggaatcgagtagaggaaaagattgttttgtttatatgagaacgatccaggcttgcatatgcttgcatatgtttgggagagaatagctgaagctgccagaaagggcatgattaaggaaactacatctttggcaagcagagagg

SEQ ID NO: 54830 - DNA, 450 bp, Homo sapiens
  misc_feature 24: n = A,T,C or G
caggctgtacattgaataaaaagnattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtc

SEQ ID NO: 54831 - DNA, 350 bp, Homo sapiens
  misc_feature 37, 317: n = A,T,C or G
atgaaatgatgagatgagatgtgatgaaatgatgacntaaaatgagatgaaatgagatgtaatgatggaatgagatgagatgaaatgagatgaaatagatgagataaaatgatatgaaatgagatgaatgatgagatgatgagatgaatgatgaaatgaaatgatgagatgagatgatgaaatgaaatggtgagatgaaatgatgagatgaaatgaaatagtgaaatgaaattgaaataaaatcgaaatgagatgaaatgatgagatgatgaaataaaatgatgaaatgatgagatgtgatgagatgaaatgatganatgaaatgatgagatgagatgacctgaactaat

SEQ ID NO: 54832 - DNA, 470 bp, Homo sapiens
  misc_feature 14: n = A,T,C or G
tgataagggaaagnacttgtttggtagcccaaggaaaaacagggtgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagcc

SEQ ID NO: 54833 - DNA, 350 bp, Homo sapiens
cactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagacctcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcc

SEQ ID NO: 54834 - DNA, 400 bp, Homo sapiens
ctgctggaaaacgcagttccggttaggcggctgagtttgtttacgttgctaacagatctagcccctgctttccctagtacgcagttacaagatggggaaatccttcgccaacttcatgtgcaagaaagactttcatcctgcctccaaatccaatatcaaaaaagtatggatggcaggacagaaaatatcatatgataagaagaaacaagaagaattgatgcagcaatatcttaaagaacaagaatcatatgataatagattgcttacgggagatgaacgtgtaaagaatggccttaatttcatgtatgaagccccaccaggagctaaaaaagaaaacaaagagaaagaagaaacagaaggagagaccgaatacaaatttgaatggcagaaaggagcccca

SEQ ID NO: 54835 - DNA, 390 bp, Homo sapiens
  misc_feature 80, 371: n = A,T,C or G
atcctatttttgtcttccattcgtcttgtgcctttgatggtgttaatttggcattttattattctctcttctagcgtggntttcttgtggttgcccttgtgtttgcagtatagatttacaaataatgcaacccctctttcaaataataatatactgcttcttgggcagtgtaccttatagtaacaaaataatcctaatttctctttcctatcccatgtatcattgctgtcattccacttatatataagcacccctaagtatgacgactatacacacacacacacacacacacacaaatatatgtgtacaaaatcaaatacattggtgccattattttgaatgaactgttaactgttagattaagaattggnaccatatggaacaggttag

SEQ ID NO: 54836 - DNA, 400 bp, Homo sapiens
agacgacgatgtggtcattggaaaggtgttcatgcaggagttcaaagaaggacgcagagccagccacacagccccacaggtcctctttagccacagggagcctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaaagacgttttcatcccgctaatcttggat

SEQ ID NO: 54837 - DNA, 240 bp, Homo sapiens
  misc_feature 225, 238: n = A,T,C or G
atagtaaggcgtcttttatcatacaaaaaggtaaatcaatgcctgattgtccaacttctcctctggtgttagggaaactggaggacttgagctcattcaggcaggatcttcttcaaagttcccatctatggagttatttgtcataatagacatgactgacaagccttggaatcattaattcctggtagagaagttcaaaaaagcatttgtttttgaaaagcaggnataccattttgtnct

SEQ ID NO: 54838 - DNA, 350 bp, Homo sapiens
  misc_feature 201: n = A,T,C or G
cacttattaagtcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattccgacttgcatggntaagaaaagcagttaaatattttactacttatcaagggcttttaaaataaataaatctgattgataggaagaaaggcaaataaatacctatgtagacattctataataacaaagagccatagatgataaaggaattagattttaatgta

SEQ ID NO: 54839 - DNA, 250 bp, Homo sapiens
  misc_feature 29: n = A,T,C or G
tatactcaattgatgccaataacttgacnaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctcccaaaaaaaaaaaaa

SEQ ID NO: 54840 - DNA, 430 bp, Homo sapiens
  misc_feature 39: n = A,T,C or G
aaaagccaactcaagtgaaattgaagtagtcgataatcngaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagc

SEQ ID NO: 54841 - DNA, 460 bp, Homo sapiens
  misc_feature 8: n = A,T,C or G
attgcagnataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtgggattacagcaagctgaaagaaggaacgcccagatttctaaatgaaatgtttcactataacgctgctttagaatgaaggtcttccagaagccacatccgcacaattttccacttaaccaggaaatatttctcctctaaatgcatgaaatcatgtttggagatctctattgtaat

SEQ ID NO: 54842 - DNA, 140 bp, Homo sapiens
tttgggttgttctgttctgttaattttcttttgcttttttgtgttttttgtttgtttttactttttgcatttaagaccattaaatttagattttgttttgctcgaaaaaaaaaaaaaaaaaaaaaaaaaaaaaaaaaaaa

SEQ ID NO: 54843 - DNA, 290 bp, Homo sapiens
  misc_feature 261: n = A,T,C or G
ataaggactaaagtaaaataattgacataatctagtaaagaattcaagtaggcagttagatatattaatctggaggtcaagggagagatgaaataaataattttggaagtctttggtgcacagttggtttttaaagccttgagagtggataagctgacaccaaaggactgagtacaaagggtaaaaagaaagggtccaaggactaagccctgagacctaccagcatttagggggtaagcagatgagaagggagcaccacangggaaaaaaaaaaaaaaaaaaaaaaaaaa

SEQ ID NO: 54844 - DNA, 400 bp, Homo sapiens
  misc_feature 18: n = A,T,C or G
catgaatgatatcaaagncattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagaggataagtccattttttaaaaatgttttccccaaaccataaaaccctatacaagttgttctagtaacaatacatggagaaagatgtctatgtagctgaaaataaaaatgacg

SEQ ID NO: 54845 - DNA, 400 bp, Homo sapiens
  misc_feature 34: n = A,T,C or G
ggcattcctgagtctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagc

SEQ ID NO: 54846 - DNA, 370 bp, Homo sapiens
tttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttc

SEQ ID NO: 54847 - DNA, 490 bp, Homo sapiens
  misc_feature 232: n = A,T,C or G
aggaataataagacacgccttgaagagtacatcgtactagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggntgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagcccctccctaggcccagtgtgccccttccgctgtcaatgccatcttcgagtggtccagtgttctgatttggggtctggacaaagtggccaaagg

SEQ ID NO: 54848 - DNA, 430 bp, Homo sapiens
  misc_feature 11: n = A,T,C or G
cattcctgaanctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaaagtgggatcgagacatgtaagcagcatcatggaggttttgaagatgcccgcatttgg

SEQ ID NO: 54849 - DNA, 329 bp, Homo sapiens
aagataatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttttaaaaaaaaaaaaaaaaaaaaaaaa

SEQ ID NO: 54850 - DNA, 370 bp, Homo sapiens
  misc_feature 226: n = A,T,C or G
aggagttgagtagtaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcaactgcctctgccaggagtctaccaaatgaagaaatagtgcagaagatagnaggaagtactttctggggtcttagatacagaactacgatataagccagacttgaaagagggctccagaaaaagtagatgcgtatctgtacaaacagatcctactgacgaaattcccactaaaaagtcaaagaagcataaaaagc

SEQ ID NO: 54851 - DNA, 376 bp, Homo sapiens
  misc_feature 369: n = A,T,C or G
cggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaaagatgtgaattcctctgaactaaaaaaanaaaaaaa

SEQ ID NO: 54852 - DNA, 410 bp, Homo sapiens
  misc_feature 20: n = A,T,C or G
tctcagcagatggactcagnagttgtggatgaaaaaactaaggaccacatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaaggtacaatctgttctacagtgtg

SEQ ID NO: 54853 - DNA, 335 bp, Homo sapiens
cgtctgcgaaatctatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattaccctagaagtttgtcactgacttgtgttcctgaactatgacacatgaatatgtgggctaagaaatagttcctcttgataaataaacaattaacaaataaaaaaaaaaaaaaaaaaaaaaaaaaa

SEQ ID NO: 54854 - DNA, 340 bp, Homo sapiens
  misc_feature 270: n = A,T,C or G
ctcgttttaaggcaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttggtcttgtattttaaaatgtcagtgcgaaaaatatatggtggaacctttctttaaagttgaaatgcagtattatttaaatctgaaaggntaaaaagctttcttcaccttatatatgttcttccactgtgactttttagttgaagactagtaaattaact

SEQ ID NO: 54855 - DNA, 380 bp, Homo sapiens
  misc_feature 328: n = A,T,C or G
agcaatctcaaataattctgaacacaaatttaatatttttttttctgaatgagaaacatgagggaaattgtggagttagcctcctgtggtaaaggaattgaagaaaatataacacctcacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggngcttgggtgtacaaaactttttatatcaaaaggctttgcacatttctatatg

SEQ ID NO: 54856 - DNA, 300 bp, Homo sapiens
  misc_feature 131, 142, 177, 188, 194, 196, 217, 243, 256, 258, 298: n = A,T,C or G
taaattgtttattttaaacttatctgtttgtaaattgtaactgattaagaattgtgatagttcagcttgaatgtctcttagagggtgggcttttgttgatgagggaggggaagctttttttttttctatanacttttttcanataacatcttctgagtcataaccagcctggcagtntgatggcctanatgcananaaaacagctccttggggaatngataagtaaaggcagaaaagattatntgtcatacctccntnggggaataagcataaccctgagattcttactactgatganaa

SEQ ID NO: 54857 - DNA, 354 bp, Homo sapiens
acccatggtagttgctgctcgtggttctgtctgtccgtgcaccgatgcacacaccgcaccccaccgctgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgccaaaaaaaaaaaaa

SEQ ID NO: 54858 - DNA, 370 bp, Homo sapiens
  misc_feature 207: n = A,T,C or G
atgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggcttttggagtcctcttcctgctgctctngggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaaaaaaaa

SEQ ID NO: 54859 - DNA, 320 bp, Homo sapiens
  misc_feature 297: n = A,T,C or G
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntaaaaaaaaaaaaaaaaaaaaaa

SEQ ID NO: 54860 - DNA, 360 bp, Homo sapiens
  misc_feature 214, 293, 317: n = A,T,C or G
ggcagagttgcagtgaaccgagtatcgtaccactgcactccagcctgggtgacaagagcaaaactccatctcaaaaaaaaaaattgggtcacagtttgggatttgctatccagacatcttgtactctacctcttttaaaatagctaagtatactaccaaaagctagattctatagcagagcatgcttcatcttcatgaaaaaacaatcgtacgngggccataatatacatataatggaatattagccttaaaaaggaaagatattctgacacatgctagctacaacatggaanaaccttgaggacattatgctaagngaaacagaccggtcacaaaaagacaaatcctgtatgattgact

SEQ ID NO: 54861 - DNA, 376 bp, Homo sapiens
ggccgggccgagtagtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaaactccagctgtgaaagcaacataaatggattttaaactgtctacggttcttaacctcatctgttaagttcccatgcctggagaagctaatgccaactcatcatgtgataattcaatttgtacaataaattatgaacctgaaaaaaaaa

SEQ ID NO: 54862 - DNA, 470 bp, Homo sapiens
aaaaataatttagtgttctaaaattctggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagaggaagcagttttatgtttgcagatattctgagtctcttcaggatgtgtttcgtgtctaccatatatgcaggataaattctttaacagcaaactccaaaggaatgttgaagctgttttagc

SEQ ID NO: 54863 - DNA, 248 bp, Homo sapiens
tggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaaaaaa

SEQ ID NO: 54864 - DNA, 360 bp, Homo sapiens
  misc_feature 226, 299, 348: n = A,T,C or G
cacttcggcctcccaaagtgttgggattagaggcatgagctaccacactagccttgttactttcttaacagtgtcttttgcataacaaaggcttttaattttaatgaagttcactatatcagttttttctttcatggactgtgcttgaggtgtcatggctaagagcagttcacaacattttcttctaaaggttttaggcttttcgtttagatctttgatgcatttntgaggttatttttgtataaggtgtgcagtgtggtagaagtagtgcatttttttttcacgtcgggatatccagngggtctcacaccatcttttggaaagacagatctgttttccatttattanaaacatgttttg

SEQ ID NO: 54865 - DNA, 383 bp, Homo sapiens
  misc_feature 229: n = A,T,C or G
atttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgnaccctgctgtataataaacaatcttagacatttatcaactgttgatacaaatgttagtccctaaccactttttatatatgttttaaaatttttgaaattcaagtgtacccttccataacataaaataaacactagactgtgtcacaaaaaaaaa

SEQ ID NO: 54866 - DNA, 250 bp, Homo sapiens
aacagtagcgagtattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcgatcggtctatagatgtgtcatgggaaactttgggttgccactt

SEQ ID NO: 54867 - DNA, 410 bp, Homo sapiens
acttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagcctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcatt

SEQ ID NO: 54868 - DNA, 190 bp, Homo sapiens
aaaggaagtctccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaaaaaaaaaaaaaaaaaaaaaaaaaaaa

SEQ ID NO: 54869 - DNA, 270 bp, Homo sapiens
  misc_feature 185, 244: n = A,T,C or G
atttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaaacactgnggataatgacaaaaagcataagtaaaaatatttgagaaaaataaagtacaagttttgancaccaaaaaaaaaaaaaaaaaaaaaa

SEQ ID NO: 54870 - DNA, 380 bp, Homo sapiens
aaatgtctgtgaattagggtaagggttaaataggcaatggggcgcacaaacaacagaatgatgctttgtggctacaggaaagaatatgggatctctctacttctatagaaagatatttaagatatatgaggaagggcaaaaagtaagattaaaaaagggcaaaaccatatttgtatttacttatgtttgctttcaagcctctgcaagaatacatgcaaaataaacaaagaaacataacctgttgcaggtgggtgagggttggaactgggtagactgagggacagggctgagagtgagacttttccctatatatatattttaaccatgtcaattaattgctttacctattcaataatttaagtaaaaaaaaaaaaaaaaaa

SEQ ID NO: 54871 - DNA, 277 bp, Homo sapiens
  misc_feature 4: n = A,T,C or G
cagnatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgttaaaaaaaaaaaaaaaaaaaaaaaaa

SEQ ID NO: 54872 - DNA, 310 bp, Homo sapiens
  misc_feature 25, 35, 81, 82, 138, 146, 184: n = A,T,C or G
cggtttggggatcaataggaaagcntatgcagccnaccaagatgcaaatgttttgaaatgatatgacccaaaattttaagnnggaaagtcacccaaacacttctgctttcacttaagtgtctggcccgcaatactgtnggaacaancatgatcttgttactgtgatattttaaatatccacagnactcactttttccaaatgagggctagtaattgcctagaaatatctttctcttacctggtatttatcaatttttcccagtatttttatacggaaaaaattgtattgaaaacacttagtatgcagttg

SEQ ID NO: 54873 - DNA, 403 bp, Homo sapiens
atacagcaagtaaacatttaaaataatgttactcagatccttaccccagctcattgtcttcgttgtttaaggtattcaaatattgtcacaattcataatagtttttagtaccttacttggtaaagagaaatactgttcagctgtgtgcttttagcagtgaagcccacgagcctctggtcataggagaaaactaaggttcttttagatagaaaggtactttggtttaaagaaaatgttagggcattttctcaagaatagaacttttgcatctgtactctttcggtcttagagaagaaaaactttctcctgggtggggaaatgacacaaatgactctactggatgcatgcaaacttggaaatgaaactagtttactcttctttgcaaaaaaaaaaaaaaaaaaaa

SEQ ID NO: 54874 - DNA, 390 bp, Homo sapiens
  misc_feature 346: n = A,T,C or G
catacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtggggaaagaataacttcagaccaccgcccaaggtggaatccagtgttgtaaggatagaacctaagaatccaccaccacccatcaattttcaggaatggggatggtctaagtaaggataacctttgttaggaaaaacaagnacactctctgctgcatttaaaatcaagtgcagtgcaacaactct

SEQ ID NO: 54875 - DNA, 530 bp, Homo sapiens
attcctgaacctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggatttggatgaattccaaattctgcttgcttgctttttaatattgatatgcttatacacttacactttatgcacaaaatgtagggtataataatgttaacatgga

SEQ ID NO: 54876 - DNA, 240 bp, Homo sapiens
  misc_feature 8, 10, 11, 12, 15, 27, 28, 32, 35, 37, 39, 60, 78: n = A,T,C or G
gatttttngnnngantaacttttcccnngtanttntncnttatggccgggcgactcttancggtggatcactcggctngtgcgtcgatgaagaacgcagctagctgcgagaattaatgtgaattgcaggacacattgatcatcgacacttcgaacgcacttgcggccccgggttcctcccggggctacgcctgtctgagcgtcgcttgcccaaaaaaaaaaaaaaaaaaaaaaaaaaaat

SEQ ID NO: 54877 - DNA, 510 bp, Homo sapiens
  misc_feature 195, 196, 494: n = A,T,C or G
atgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcnngctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattggcaccttgtaatattcagagagcacttggattatggatctgaatagagaaatgcttacagataatcattagcccacataccagtaacttaaagatgggatgggagttgtaaagtgcttttataatacaatataaattgntaaaggcaaaggggtg

SEQ ID NO: 54878 - DNA, 420 bp, Homo sapiens
aagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgagtagatgtggatgactgtcaggatgttgcttcagagtgtgaagtcaaatgcatgccaacattccagtttttttaagaagggacaaaaggtgggtgaattttctggagccaataaggaaaagcttgaagccaccattaatgaattagtctaatcatgttttctgaaaacataaccagccattgg

SEQ ID NO: 54879 - DNA, 386 bp, Homo sapiens
  misc_feature 196: n = A,T,C or G
ggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttnggggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagccaaaaaaaa

SEQ ID NO: 54880 - DNA, 310 bp, Homo sapiens
  misc_feature 215, 217, 288: n = A,T,C or G
attcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaaaagcntntttgtcacagaaatttagttaacatcttacaactgaacatgttttgtatgttgcttagataaatgtaatcnctgtaaacatctatatgatctg

SEQ ID NO: 54881 - DNA, 460 bp, Homo sapiens
  misc_feature 13, 22: n = A,T,C or G
actgtaaacaggnctttagtcnctaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaattttgtttgacattccatgttaaactacggtcatgttcagcttcat

SEQ ID NO: 54882 - DNA, 350 bp, Homo sapiens
tctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaatagtaaaaaaaaaaaaaaaaaaaaaaaaa

SEQ ID NO: 54883 - DNA, 470 bp, Homo sapiens
  misc_feature 21, 22, 200: n = A,T,C or G
aaaacagtgaagatattcttnntttatgatgatcaaattaagacattctcagatgaacgaaaactaagataatttgttgccagcagacttatcctagaatggttaatggacattctatgaaatggagaagaaaaaatggaaagagtaaaagtacggctaaatacaataaagtttccttctctttaatttttaacttatgncactgtgcagacatcaaaataacagtaaaaggatactaggaataactctacatacatacatttggtaatttagatgaaatggatctatttctaaaaaaacgctaccacaacttaccaaatctgaaatactataattaccctgtaactattaataaaatttaatttgtaacttaaaagcatgtaacataggaaaacctacatgtacatgtgttttcaatgggcaattttctgaaacatttgaagaagaattcacactaatctagtatagat

SEQ ID NO: 54884 - DNA, 400 bp, Homo sapiens
  misc_feature 337: n = A,T,C or G
aactgctgatagcccttactgagggcaaaagatggctatattgttagctatactcctaccaaagcaagcaaggagataggattatagataatttcacggacatttggaaataacattggtgattatacagacaagaataaactcacttcaagctggtctggtttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgnaatatatttgcacagtagatgctatggatcattctgagctcagggtccagactttattcttat

SEQ ID NO: 54885 - DNA, 430 bp, Homo sapiens
  misc_feature 200, 201, 202: n = A,T,C or G
tgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgtgnnnctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactatttgtggtctgcatgacataaacaaacaaatggtgatatcaaagcaacg

SEQ ID NO: 54886 - DNA, 440 bp, Homo sapiens
  misc_feature 13, 25, 51, 58: n = A,T,C or G
ctgttcgaagacnttttggaagaantactgagaacggcataaagtgaagantcgacantttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattccgtgtgaatcagactaagtggggatttcatttttacaactctgctctacttagcctttggattttagaagtaaaaataaagtatctctgacttttct

SEQ ID NO: 54887 - DNA, 200 bp, Homo sapiens
  misc_feature 1, 21, 23: n = A,T,C or G
nctgagaagttgttgcaatantntgattactacaaaagacaaggatgatgagctgtcactttactggagggtgcaatcactttatgttataaagaagaatgatgatggctggtatgaaggagtctgcaatcgagtgactggtctgttccctgggaactatgttgaatcaatcatgcactatactgattaatttttttttt

SEQ ID NO: 54888 - DNA, 250 bp, Homo sapiens
  misc_feature 17, 164, 220, 221: n = A,T,C or G
aaatattttgagctgantgcaaatgaaaatgcaacatatacaaaagttgtggtatgcaactaaatcagtgcttagagaaaagtttatatcattaaatgctattagaagaagaagaaagtgtaaatgatttatgcttccacataagaaacagaaaaagaagacanattggaaatccaaagcaaggccaaaaaggattgaaataaagaacaaagcagaagcnngtgaaaaaaaaaaaaaaaaaaaaaaaaaa

SEQ ID NO: 54889 - DNA, 280 bp, Homo sapiens
aatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttcccctggtcaccaaggcaagtgca

SEQ ID NO: 54890 - DNA, 454 bp, Homo sapiens
agctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggttttacgaccttcgatgttggatcaggacatcccgatggtgcagccgctattaaaggttcgtttgttcaacgattaaagtcctacgtgatctgagttcagaccggagtaatccaggtcgggtttctatctacttcaaattcctccctgtacgaaaggacaagagaaataaggcctacttcacaaagcgccttcccccgtgaaaaaaaaaa

SEQ ID NO: 54891 - DNA, 500 bp, Homo sapiens
  misc_feature 196: n = A,T,C or G
gacataagtaaaaccaatgtgaatggaggagccattgctttgggtcacccactgggaggatctggatcaagaattactgcacacctggttcacgaattaaggcgtcgaggtggaaaatatgtcgttggatcagcttgcattggaggtggccaaggtattgctgtcatcattcagagcacagcctgaagagaccagngagctcactgtgacccatccttactctacttggccaggccacagtaaaacaagtgaccttcagagcagctgccacaactggccatgccctgccattgaaacagtgattaaagtttgatcaagccatggtgacacaaaaatgcattgatcatgaataggagcccatgcctagaagtacattctctcagatttgaaccagtgaaatatgatgttttttctgagctaaaactcaactatagaagacattaaaagaaatcgtattcttgccaagtaaccaccacttctgccttagataatatgattat

SEQ ID NO: 54892 - DNA, 270 bp, Homo sapiens
  misc_feature 23: n = A,T,C or G
actgtcaatggtttctctaatantttacttgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgtaaaaaaaaaaa

SEQ ID NO: 54893 - DNA, 430 bp, Homo sapiens
ctttgtaaaagtttttggcccatgtcacactttctgtaccaaatactgaatcagttcagtgcaggtttaagcaggaagaaatgtaataaaggaaattaagtgtatcagaaagactggaggagcaggttctaggtctggtctcctaaaatgatgtttccattagtgaaattaccattgttgaggccatcaccagaactacgctgaaagcaagaagccatcattattattgccattacaacttctcacactcaggaagctggaggaaaaaacacttaattcataacaaaaatggaaagaaagagtaaaactattgttattcacagatgacatgaatatgtacgtagaaagtcctaaagaatctacaaaaaaaaaaacctgatagaactaattgaatttagcaaaatctcaatagatgagttcaatgtataaa

SEQ ID NO: 54894 - DNA, 380 bp, Homo sapiens
  misc_feature 24, 67, 116, 215, 340, 372: n = A,T,C or G
aacattcacattgctctggctacnttggccctgaactattctgttctgctttcataaagcaccatancattgaagggaaagcccaatgtttgtcactaattagcacaatcttggangtagtacaagacctagaagccacttttagacttcttgtggctcttggaacacttatcagtgatgattcaaatgctgtacaattagccaagtctttaggngttgattctcaaataaaaaagtattcctcagtatcagaaccagctaaagtaagtgaatgctgtagatttatcctaaatttgctgtagcagtggggaagagggacggatatttttaattgattagnggttttttcctcacattttgacatgactgatnaccggata

SEQ ID NO: 54895 - DNA, 296 bp, Homo sapiens
  misc_feature 64: n = A,T,C or G
ttagctgggagtcttcccacatgtggcacttcaaaaggcagcaccactgggcgcctgcacttantttgaaaatggaactttgggagaagtatccctgctagtggctctgtaacttaacagatgacaattaggcttttgtcattgttgccatcatatggaagataatgttcacatccttttaaacatttttatatgacaattcctcaggatttggtaaggcttccaagttgtagcttttagttgtaagtgctggggtggtaataaaatgttacctccaaaaaaaaaaaaaaaaaaaa

SEQ ID NO: 54896 - DNA, 550 bp, Homo sapiens
cacattagataatttaatccatgtatcaggtaaaaacttgaacaaaccttttggcctcttccttaaaattcagggaagcatgtcctccacaaaacagaatcaaaatataaataaaagactgccttaagacgaaaggaaaccttacagatgaaaagaagccagatgagaggcacttaactaagaatgaaaagaaactggagtggacaaaataattattgaggaagatgaaccttcaaatcagaaagagggaaaaaagcttatttgatactatgggaactcaaaagagagtgaacacaaatgtgaaaattccaagagtgaagaaaagtatcataactacatttagagcatgagaaaaagtatacaattttgagtaataagaacagaaatcaaaagtaactattgtatgctgtattttagtagagcaacactgaagaagaaagaaaacaagaaataatattaaatatgaacatatggagaacagaataatatttttaaaatttttagtttctaagcttatctgaaattttaattttcttttcttatgtaatac

SEQ ID NO: 54897 - DNA, 340 bp, Homo sapiens
  misc_feature 195: n = A,T,C or G
ctgcacattgcctgttctgcttcgaagtattcaataccgctcagtatttttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggnccgcaatactgtaggaacaagcatgatcttggtactgtgatattttaaatatccacagtactcactttttccaaatgatcctagtaattgcctagaaatatctttctcttgcctgttatttatcaatttttcccagtatttttat

SEQ ID NO: 54898 - DNA, 490 bp, Homo sapiens
agcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggagggcctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaaatttgtcacggattaagttgtacaactagtttagaagtttcagaataaacatgcatttcataactgtcaaatgttcttt

SEQ ID NO: 54899 - DNA, 476 bp, Homo sapiens
tgcccaatgctacttagtttgtaaagatagtaagaaagaagcacctctcttgccctatggggaaaatgagcagagataaagagagggtggatatcaatgcacaccaataagtctctcaaaagagttctccattgctaatctattctgatcagtctctttaactcatcttatatgccccagatgcaacttggtgtaagacttacacaatctctcagtactattattttagaaaatgaataatcaaacattcataattggaggggaaaggtagagatacacatacttagttccagattgttctagtccactttctttcctagcctactttgaagaacaaggagcagttattaaacataatttaaccttctttttttcaacaaagtgagttatcatttgaaccaagtgccagaaccttgtggcattatgaactgtcataaaatgtgggtaaaagcttaaaaaaaaaaaaaaaaaaaaaa

SEQ ID NO: 54900 - DNA, 278 bp, Homo sapiens
atctcccagtactcactttttccaaatgatcctagtaattgcctagaaatactctttctcttacctgttactttactcaatttttcccagtatttttactacggaaaaaattgtattgaaaacacttagtatgcagttgataagaggaatttggtataattatggtgggtgattattttttatactgtatgtgccaaagctttactactgtggaaagacaactgttttaataaaagatttacattcctaaaaaaaaaaaaaaaaaaaaaaaaaaaaaa

SEQ ID NO: 54901 - DNA, 156 bp, Homo sapiens
  misc_feature 67, 73, 74: n = A,T,C or G
taggaagtttcttcaacaggattacagtgtagctaccctacctgctgaaaaatcaagcctttaaatncttttnnacttacaaactctgtataatagagataagtccattttttaaaaatgttttctccaaacaaaaaaaaaaaaaaaaaaaaaaaa

SEQ ID NO: 54902 - DNA, 246 bp, Homo sapiens
  misc_feature 30: n = A,T,C or G
tccgcagggtctagccatggctaaggagantggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaaaaaaaaaaaaaaaaaaaa

SEQ ID NO: 54903 - DNA, 168 bp, Homo sapiens
aaaaaaaataatgaagcataaggaatgctagtattagctgggtgtggggcactcacttgtagtcccaactactggagaggctgaggcaggaagaatgcttgagcccaggagtttgagtccagcctgggcaacataacgagaccccatcttttaaaaaaaaaaaaaaaa

SEQ ID NO: 54904 - DNA, 337 bp, Homo sapiens
  misc_feature 32, 309: n = A,T,C or G
caagtttaaatgactgtgctgcccctttcacntcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttgttcaaatgattttaattattgggaatgcacaatttttttaatatgcaaataaaaagtttaaaangataaaaaaaaaaaaaaaaaaaaaaaaa

SEQ ID NO: 54905 - DNA, 450 bp, Homo sapiens
ttattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatattttattttcattttctgtattatatatgaaaagtaaattaatgtgaaacctggcccagcttgctggaaagcaggttttaaattgtaaatattccttagaggagca

SEQ ID NO: 54906 - DNA, 380 bp, Homo sapiens
  misc_feature 353: n = A,T,C or G
aagttgtaggtgattaaaataatttgaaggcgatcttttaaaaagagattaaaccgaaggtgattaaaagaccttgaaatccctgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaancaaaaaaaaaaaaaaaaaaaaaaaaaa

SEQ ID NO: 54907 - DNA, 430 bp, Homo sapiens
  misc_feature 366: n = A,T,C or G
atggggacaataaccacagtcagggcgttaactggttccaccggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgtttttggtggnttgattcagcaaaaatctcccagtgacaacatcgcaatagttttttacttctcttaggtggctc

SEQ ID NO: 54908 - DNA, 550 bp, Homo sapiens
aagtcaaaatgggtcatagacctaaattcaggaactaaacaataaagtaaaaaactcacagaatgggagtaaatatttgcaaattgtatatctgattggaaactagaatccagaatatataaagaagtcttacaattcaacaaaagacaaataacccaaataaaaaatggtcaaaagatctgagtgaacatttcttcaaataagatatgtaagcagccagaaaacacatgaaaagatgcttaacatcattagctatcaggtaaatgcaaatcaaaaccacaatgagatactacttcatatcattgtcttgtgaaaaaagacaaataacgagtgttggcaagatgtggagaaaccagaaccctcatccattgctggtgggaatgtcaagtggtatagctactttggaaaacagtctgtcattttctcaaaaacttaaccgtggagtcaccatatatcccagcaattcccctcttaggcgtataaacccaagataacagaaaatatttgcccatgtgcaaaacttgaacacaaatatccatggcagcactat

SEQ ID NO: 54909 - DNA, 410 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagtttaa

SEQ ID NO: 54910 - DNA, 500 bp, Homo sapiens
  misc_feature 451: n = A,T,C or G
taaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggtttggggtgcattcagtagtccatctttggggaacggaggcgtacttgccattgattcacatgactacatgaaattctgtactgtcatttcccagatgtttggccacagaaacttttttccacttatcatttgttaacagcctgcaaaactaaacttgtacatggcagtggttcccagacttttgattttatggacccggtagtaatatttccaaaaatctggggactattaaggttgncaatttaccttgccaagtaatccgaataaatcactgtattatcaccatt

SEQ ID NO: 54911 - DNA, 440 bp, Homo sapiens
atataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttactttcgctttttttgtgcacttctatgacatggaattatttgggaagaagaagctttcttggcttgggaaagaagatataacccaagagtttcccgggaaaaggcaaggctttgttccaggtgaatcagtggctaacctggttag

SEQ ID NO: 54912 - DNA, 480 bp, Homo sapiens
ttgggaggaggcaaaacgttcttaagcttataatgtagtggcaccttataggtaagacttaaagcctcaaagctttgttttaaagcaacgactggtgttgattctcagtcaatttaaaggatgaaaagggctgtaaaactattttacggtaggaataatagctaccactttttaagcactatgttacagggattttaaatatattagctaatttaagcctaatggcagccttgtcaggtaggtacctttgtccccagtttatatacaactgcaaattctgagacaaaggatagttagacagttctgcctgatcccaaagccagtgctcttcaattcactgcagtaagccacctctctggagctgaaaggagacatgaaactagggacatgagataaatgggtttttttttctctaaagaattgccatttttctggatcttggatagagctttaccttgagaagtaaccacgcttgctctt

SEQ ID NO: 54913 - DNA, 459 bp, Homo sapiens
tttatggccgggctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtaaaaaaaaaaaaaaaaaa

SEQ ID NO: 54914 - DNA, 390 bp, Homo sapiens
  misc_feature 40: n = A,T,C or G
aagaagtagattgtgactttttttcccttagagatactantttactactctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatgggagctggggctcaacccactg

SEQ ID NO: 54915 - DNA, 266 bp, Homo sapiens
  misc_feature 12, 77: n = A,T,C or G
tttttaggaacnaaggtgtttctccaaaacacaaaatgttgggtgaaactgggaacaactactcagaagctaatttntttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctaaaaaaaaaaaaaaaaaaaaaaaaaaaaaa

SEQ ID NO: 54916 - DNA, 370 bp, Homo sapiens
  misc_feature 30, 31: n = A,T,C or G
catcccactttcagaccaagtagtacaatnntctatgggataaaggaataacaagcacttggctcagtgtgtttgtgaccttgacaacagttgcttttttggaaaaactcaaggttagcatttatattgttattttctgtgttatcatttgatttctagctcaataataaagtcaattttttatctgaacattgagtagtttataattgcttaaatattttcatgccattataattagacccagaatttatttattgattaagagccatctctctttttggaatattgtggttcagttaattgttggcaagtgatctctcatgggtaactcatgtcctggagttacttaatactttatcaagtatattct

SEQ ID NO: 54917 - DNA, 290 bp, Homo sapiens
  misc_feature 28, 264: n = A,T,C or G
atggcttgagagtaaaactcctttaacngttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccagggtatggcaggngatttttttatagcatgcactataaa

SEQ ID NO: 54918 - DNA, 510 bp, Homo sapiens
  misc_feature 4, 450: n = A,T,C or G
gccngaagccttatgaaaattatactgagtaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaaatttaagttctattcagccttccctgggtgttagaacctagattcaaaatggcttgtctttgctaccttttgttccacattctctctctttaccttttgccctaccttctgtttggaaggatgattttaattattaatttccaggaacacatgntttttatttcctctgctggaataggagaaagcttaatatattcccaagctgaatggtctt

SEQ ID NO: 54919 - DNA, 252 bp, Homo sapiens
ccccactctaaagctgatgaatcagaatctgcctttaaaatatatgggtaattcatgagtacactgtagtttgagaagctctggtctagaatacactgaagtagcagctttttacaactagacagatgagcaaaacacaagtgaacaaagaatatagaaggggaaacttgcagatgatatgatcgtacatgcagaaaaccctaaggaataatttttaaaaattaaagccaaaaaaaaaaaaaaaaaaaaaaa

SEQ ID NO: 54920 - DNA, 388 bp, Homo sapiens
agaacatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccgtgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctg

SEQ ID NO: 54921 - DNA, 383 bp, Homo sapiens
  misc_feature 54: n = A,T,C or G
gttccgcatcagtctttaaaaaatattttagcctaagttttctaagaggtatgntgaatacatttttaaaagccagcttaagggtcacagcagccttagtttaggagaagagctaatcacaggtgaccactcaagttctttcaatgaagacctgatgatgtatttagttcccattttccacggtgattgactcaatttaagtgtattgtggctatatgtaatttacaggctgctttgcgttgcaggtgggaaaatctcccaggctggtgtgaggctgaactggggtaaaagaccccctgacccctcctcattcttctaaggtcaccacctcttagagggtctcttattttctttcagagatcaaatgcacagttatgctgtac

SEQ ID NO: 54922 - DNA, 358 bp, Homo sapiens
gggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctg

SEQ ID NO: 54923 - DNA, 330 bp, Homo sapiens
  misc_feature 267, 269: n = A,T,C or G
agttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatattttttggcattcctctaatgttgtgtgttttttttttgngngctggagggaggggatttaattttaattttaaaatgtttaggaaatttatacaaagaaact

SEQ ID NO: 54924 - DNA, 127 bp, Homo sapiens
  misc_feature 16: n = A,T,C or G
atggaattgattcttnaaataccaatactcatggagctgaggagagaaacagaaaattgaagaaacattggaaactctgtcatgctcagtcaagattagatgtcaatggactagcattaaaaatggc

SEQ ID NO: 54925 - DNA, 372 bp, Homo sapiens
gtccaggtgaaagggacccggcaaatactggcattagaaagtaacttgatgatcttgctgtggtgggaaactgtcccaatcctggttcagttttttgtttaagcacaatgaaatctgttttataactcgtttcattaacattttatcttgaacgttttcccacactgttttgttttctccaacattgttattgtctctgacattatttgttgaatatattgataagcataactaatccattgttactttgaaagcagttagttcaaggaggatgtagtcaggaaaatggtggcatagccagatgttctggaactatgtgaatggtgactatcatttggggacatggatgaaaatagattaggtgcatgatga

SEQ ID NO: 54926 - DNA, 107 bp, Homo sapiens
aggagaaggctgagccaagggaactgtgaaggggatgggcaggagggcttgtgcagggttttgtaagcagtgatctagtttcattaaaaaaagaaaacaataaccct

SEQ ID NO: 54927 - DNA, 312 bp, Homo sapiens
gtaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagtccaatgcttcactcagccattttac

SEQ ID NO: 54928 - DNA, 372 bp, Homo sapiens
  misc_feature 5: n = A,T,C or G
gtacnacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgta

SEQ ID NO: 54929 - DNA, 191 bp, Homo sapiens
gtgcagaggaaaagtttggtgaacttggaggcataacaatagaaactattaatgaatcacagacagaaaagatgattaagtaaaaagagcatcagtgaagtgtgggacaatgttaagtggtctaacattcaagtaatcggagtctaaaagaagaagctgaggacaaaaaacatctttgtaggagtaacagg

SEQ ID NO: 54930 - DNA, 398 bp, Homo sapiens
  misc_feature 12, 22, 44, 45, 47, 48, 54: n = A,T,C or G
cggccggggttnaaagcagacntgccttaaattggcactaagannannttcccntttcacaggtaaccgtgttccagtttaatgattaccttcatactcaacaagaaaaatggcaaagcaacatcatcaaaataggtcttacaacatatctacatgtatatatgtgtatatataggattcatataaacatacatacatatatatgcattcatatgttggaaaacaaaaggaataagctaatatgttttatttccttcattaaaccagtatatgagtattttttaatttggcaaacaaaaatcaacatactgaaataagtaatacagggtactgagcatttctctatcagcaaatcaatgcctacagtttttatgaaccattgcacagttcaactcgac

SEQ ID NO: 54931 - DNA, 372 bp, Homo sapiens
gagggcaatcacactctcagaaactgcggcggctctggactgcagcctcccaaggctccatgccagacaaagcatgcgtgtcacacttgctacaatagcctggatggtttcttttgtctccaattattcacacacagtaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacat

SEQ ID NO: 54932 - DNA, 304 bp, Homo sapiens
aacacagagcagtggtttgtagtactcaaactttctttccctgtaatcctcattgacgagatgttgaagttccttgcccgcaactatgtggatgtctaaacagttctcacctcccagatttcaagtaacagaagcaagctatagcttgaagtataaagacaaagatggtgaaaaacagcagaagagaacagcaagaggaaaaaaaagaggaacaatggggaaaagagaatttacatctgctaagacagaagctcccatgagcccatccacagaatggagagcacaacatcactggaaaatattt

SEQ ID NO: 54933 - DNA, 373 bp, Homo sapiens
ctctgtgaaaacagcgtgcagcggcacattggacatgctaacctcaccttcgagcagcttcgtagcctgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagctatttttaagaaatgataaggtaacccaaggtccaatcagtaaaaata

SEQ ID NO: 54934 - DNA, 177 bp, Homo sapiens
agatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatct

SEQ ID NO: 54935 - DNA, 369 bp, Homo sapiens
gaggcgcgatgttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaag

SEQ ID NO: 54936 - DNA, 372 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagatta

SEQ ID NO: 54937 - DNA, 361 bp, Homo sapiens
  misc_feature 26: n = A,T,C or G
attacctggttctgctatccttagtntaactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacagaaaaatattttaaagatataaatatatgctgtatatgttatgtaatttattttaggctataatacatttcctattttcgcatttt

SEQ ID NO: 54938 - DNA, 344 bp, Homo sapiens
aatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattatttttaagtattacaaaaggcagcttgcttcttaatctatgcatctttggggtttttgaagaaatttaattctttgatgtaaaaaggaactgttaaaaaagttggaagctctgcacctgtgtatatatatatttttagca

SEQ ID NO: 54939 - DNA, 128 bp, Homo sapiens
  misc_feature 1, 106, 121: n = A,T,C or G
natttcagcagatcttttctacctactttgtgtgatcaaaaaagaagagttaaaacaacacatgtaaatgccttttgatatttcatgggaatgcctctcatttaanaatagaaataaagcnttttgtt

SEQ ID NO: 54940 - DNA, 143 bp, Homo sapiens
aagataatgcaggagtatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 54941 - DNA, 372 bp, Homo sapiens
gaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctccgtatatcttcctacctttcaaaatcgttcttagggttagtcaagtctggaatataattgctgactataaagttagcaattatgcttttaagggtgttgtcacatcaacctaaagagaaccatctatggaaggta

SEQ ID NO: 54942 - DNA, 372 bp, Homo sapiens
ggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaattt

SEQ ID NO: 54943 - DNA, 308 bp, Homo sapiens
cacccaaacacttctgctttacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgtttt

SEQ ID NO: 54944 - DNA, 249 bp, Homo sapiens
ggcttttgccacaaaagttgcagttcttggtgctccagtgctgatgtcttgttactgaatagattggagaatagggcatgcagactctggaatgaagttatctgtggcaggatattaaattgtactttgtaaactgagtttatttttgtacccattttcttattcacatttcattctcctttagtatttgttaaaatatttcagaaattttaaaaaagttattatatatggccgataattattagtatt

SEQ ID NO: 54945 - DNA, 368 bp, Homo sapiens
  misc_feature 7, 82, 307: n = A,T,C or G
gctttcnacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagcagtctgggccaaaggaataaggaatgtgccataccgaatccgtgtgcggctgtccagaaaacgtaatgaggnatgaagattcaccaaataagctatatacttttggttacctatgtacctgttaccacttttc

SEQ ID NO: 54946 - DNA, 274 bp, Homo sapiens
  misc_feature 35, 272, 273, 274: n = A,T,C or G
agtaaggtttgggccacacaaagtatatttttatnatggaaaaatttcaactcctcaagccgtaatgttgaacagaattgaagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtnnn

SEQ ID NO: 54947 - DNA, 261 bp, Homo sapiens
  misc_feature 261: n = A,T,C or G
gaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtgn

SEQ ID NO: 54948 - DNA, 372 bp, Homo sapiens
gagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaaggaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggat

SEQ ID NO: 54949 - DNA, 372 bp, Homo sapiens
gggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcat

SEQ ID NO: 54950 - DNA, 371 bp, Homo sapiens
aggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaaga

SEQ ID NO: 54951 - DNA, 372 bp, Homo sapiens
aaatgcagtcattgcagctgtgtgtgccactgaggtttttaaaatagcccaagtgcatacattcccttgaataattacttggtgtttaatgatgtagatgggctgtatacctacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgat

SEQ ID NO: 54952 - DNA, 367 bp, Homo sapiens
attcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagt

SEQ ID NO: 54953 - DNA, 358 bp, Homo sapiens
gtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgccgtgccgtgtgtgatgtcaggctgccacgtaaaacttcagagaaaaatcttaaaagcagaccatccttttttgcatgctctattctaagtagaatgttcaatgtaactgactaaaattgcatgttaaagatatttaggttttttttg

SEQ ID NO: 54954 - DNA, 473 bp, Homo sapiens
  misc_feature 3, 92: n = A,T,C or G
gcnaatcctttgaatgttccacggaaaacactggtggacagaattctagtgctgagaagaaacacgtttggtttggagagtccatggatggnggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattgggggtcctgatcaagaatttggtgtggacgttgg

SEQ ID NO: 54955 - DNA, 364 bp, Homo sapiens
  misc_feature 9: n = A,T,C or G
atttttatnaattattaaaccttctcttctagtgtgtactagtatttatttctacttaaactgctcagctctaaagaaattgtatgatcactttaaaggtactaaatccctgaaattttgcttcatcttacccacaccgctagtttactttccttttttaatatttaagaatattataaatcagtgcatttgaggtccctagatttgtttttcacctatgaattttttacagactattttagagaggctgtggtttgaagacagaatactctttacatgctaacttttgaaggttggtaatgtaatttatactattttccttcagtgcaggagatttttttaagtaaataagtaaattttagca

SEQ ID NO: 54956 - DNA, 343 bp, Homo sapiens
  misc_feature 11: n = A,T,C or G
ataatttaagnagactgatttaaaaataacattatgcttttggacacataatatataaaggtgtaattttgtgacatcaataactaaaagggttggggacagagccattcagggagcagagttttgtttatgccgttgaagctaaactggtataaattcagtgtagactgttataattttaggatgttaaaatgcaatccccatggtaacaacaaagaaaataactaaagaataaatacaaaagggaaatggaggaagggatttaaatgtttcaccatcaaaaaaattaattaaacacaagacagtgatactggaaattaaggacaaaaaaaatccataaggt

SEQ ID NO: 54957 - DNA, 469 bp, Homo sapiens
ataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcaccccaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgtatgtgccaaagctttactactgtggaaagac

SEQ ID NO: 54958 - DNA, 477 bp, Homo sapiens
gatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgggg

SEQ ID NO: 54959 - DNA, 385 bp, Homo sapiens
  misc_feature 12: n = A,T,C or G
ggtgaatcagtnactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccct

SEQ ID NO: 54960 - DNA, 371 bp, Homo sapiens
ggtaaactgagattgcaaaatgtagggaacaaaataataaaatataaagggtgacaatattgcctgtgaattcatacaatcaataaggaaactgttacacagttgttttgtaccttacatataaaaaagaataggcacaacttaaatttataattatttagttataatgaatgatttgtgataggaaaaatttaagggtgacaatcctcagaaaattaaaaaaattaaaatatatgtgattttgatgaaaaaggtctacccatagggaggatttagaatgaaatgacctcttaattcttatgtcttaattgttgccttttaattacgagatagggaaaagttatcaaaactgaagatacatcagtggatga

SEQ ID NO: 54961 - DNA, 372 bp, Homo sapiens
  misc_feature 220, 275, 324, 332: n = A,T,C or G
gaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgagagaaaggnctacaganccccgaattaataccaatagaagggcaatgcttttagatt

SEQ ID NO: 54962 - DNA, 474 bp, Homo sapiens
  misc_feature 15: n = A,T,C or G
agaaaaagtctttcnaactgtttaagtatttaaacctctgagccaaagcagatagaagttattgtataattgttaatcactttgcaaataggggctatcagattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgcct

SEQ ID NO: 54963 - DNA, 272 bp, Homo sapiens
  misc_feature 253: n = A,T,C or G
actaagggatgatctttgaggaaacagacctggagggaggtaatttaaggagggaaagcgagtgggttttacagactgctttgtggcgacattcaggaacagaccattcaatggatgacttttcagtacataaaagcaagcagtaatggccaggagagagcaaagatgccctaagaatgacatcagactgaccaaatgtgccttttcaaataagttatgagaacgaatgaattggaattagagcaaggtattnggacagaaaccatgctagt

SEQ ID NO: 54964 - DNA, 500 bp, Homo sapiens
  misc_feature 3, 16: n = A,T,C or G
ccngggtatttcggcnttatggcggggatacacaaatcagtaaatgtgatatactacattaacataatgaaggacaaagatcatatgatatctcaatagatacagaaaaagcatttcacgaaattcatcctttcatgataaaaattctcaacaaataatgtatagaaggaatgtcttcaacacaataaagactgtatattacaaggccacagcaaacatcatactccacggtgaaaagtttaaagcttttttctctaatgtaaggaattagacaaagatgctcactcttgccacttttattcaacatagtactgaaagttctatccagatcaattaaggaagaaaaagaaataaaatgtactcacatcagaaaggaataagtaaaattgtctgtttgcagattacatgattttacatagagaaaaccccaaagaccccaccaaagactgctgtaactaataaataaattcagtaaagttgcaggataaaaaagcaacaca

SEQ ID NO: 54965 - DNA, 361 bp, Homo sapiens
  misc_feature 146, 316: n = A,T,C or G
aacaccgatgagattatgacttcactcaagtctgttaatggacaaatagaaagcctcgttagtcctgatggttctcgtaaaaaccccgctagaaactgcagagacctgaaattctgccatcctgaactcaagagtggagaatactngggttgaccctaaccaaggatgcaaattggatgctatcaaggtattctgtaatatggaaactggggaaacatgcataagtgccaatcctttgaatgttccacggaaacactggtggacagattccagtgctgagaagaaacacgtttggtttggagagtccatggatggnggttttcagtttagctacggcaatcctgaacttcctggaagatgt

SEQ ID NO: 54966 - DNA, 472 bp, Homo sapiens
gagagtaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaattta

SEQ ID NO: 54967 - DNA, 396 bp, Homo sapiens
ataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgataaga

SEQ ID NO: 54968 - DNA, 446 bp, Homo sapiens
atcttaaggcccaatcaagatcccatatcctgattttgaactatgtgaaagtgggactgttaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagatccactattttctgctcaaaggtttcgcctacctaaagtggaacatgttaaaaatctatgtgaccatcactggacagctttctctcaaaactttccttcaacgccatggattagcaccagttttg

SEQ ID NO: 54969 - DNA, 428 bp, Homo sapiens
ggaagcaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaaga

SEQ ID NO: 54970 - DNA, 230 bp, Homo sapiens
  misc_feature 59, 206, 210, 213: n = A,T,C or G
tacatactaaatctctctccttttttaattttaatatttgttatcatttatttattggngctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcntttngtnttaaagaatttaattct

SEQ ID NO: 54971 - DNA, 472 bp, Homo sapiens
  misc_feature 32, 33: n = A,T,C or G
ggtaggcagcctctctccctactgctgctacnnaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaaatctctttttttctggaggctggcacctgattttgtatccccctgtagcagcattactgaaatacataggcttat

SEQ ID NO: 54972 - DNA, 494 bp, Homo sapiens
  misc_feature 18, 20: n = A,T,C or G
aatgaaattgctgaaagnanctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgaga

SEQ ID NO: 54973 - DNA, 428 bp, Homo sapiens
gccttttggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgct

SEQ ID NO: 54974 - DNA, 395 bp, Homo sapiens
  misc_feature 7, 31, 32, 377, 380, 381: n = A,T,C or G
ggaaggnggagttgagagaacggagcggacnncatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaaagtagatgcgtatctgtacaaacagatcctactgatgaaattcccactaaaaagtcaaagaagcataaaaaagcncannaacaaaaaagagga

SEQ ID NO: 54975 - DNA, 375 bp, Homo sapiens
  misc_feature 6, 9, 34: n = A,T,C or G
ataatnagnaagggattacacccccacagtaatnaaataagtacccatgaatccatattgacaaaaataaatgattagatgaatacagaaatgcaggagaaaggtcaaccttccttacggtagaatactaattaatattgtagaaagaatgtcagaaatagaaaataactattttacaaactaatttaacagtaataattgttacaggagcagaatcatcaatgatgctaaaattagtaggtgaaatatgatgggaatcaggatatttacataatctcaaagtgttttcttacaggacacatattatttacagatacgcagggggaaatactaacttatgtggagaaatctagaatataccactcaaccaagtat

SEQ ID NO: 54976 - DNA, 170 bp, Homo sapiens
cttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggtttt

SEQ ID NO: 54977 - DNA, 311 bp, Homo sapiens
  misc_feature 29: n = A,T,C or G
gccgccaggaattatcttgggcagctatntttttatatattagtatttctgcaggatgaattcctagaagtagaattgctctgtcaaagggtttgttactcatctgaaccttaaaaagactggtttcttgaaaactcagtctcttaaagcgaaaattaacaaaacaactttagttttaaactaaaaatgggattaggccaggaatggtggcttatccctgtaattccagcactttgggaggccaaggtgggatgattgcttgagcccaaaagtttgagaccaacctggacatagcgagacctcatctctac

SEQ ID NO: 54978 - DNA, 380 bp, Homo sapiens
cttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttacctgtaagctgtgttcactcttttatacaaatgaaga

SEQ ID NO: 54979 - DNA, 212 bp, Homo sapiens
  misc_feature 2, 21, 35, 43, 46, 52, 62, 65, 121, 143, 148, 166, 189: n = A,T,C or G
tnttgggttgtgaaccttccnaaaaaaaagggaanaataaatnccngttccntgttatcaanaanaaagagagggctgttttggaaaacactaacatcattggccttttctttggcgagtngctggaatattttaggaagtanctgtncttttgctcttataaacncagttaaatagatactgcctctngtccttctcttgcccttatatag

SEQ ID NO: 54980 - DNA, 356 bp, Homo sapiens
  misc_feature 5, 12, 28, 43, 48, 55, 56, 57, 58, 346: n = A,T,C or G
ccggntgggatnaataacctcaaaattntataaaatgattttnccttntgaacgnnnncagaagggagagtggtatagatagaaaatgacaaagatggcaatatacacttaatgttattattgcatgttgttactgaagtacttagatttttaaaatttcaaatcctaaatcacttcttgtaggagggttttcattaactacagtatatacagttcactacatatgggctgtttgagttttttgtgtgctgtatttctttctgttttttaatacctggttttgtacatatctaactctgttctcttttggttgttcagaaactggattttttttttcttaagcagngcttaatttg

SEQ ID NO: 54981 - DNA, 293 bp, Homo sapiens
tatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttct

SEQ ID NO: 54982 - DNA, 474 bp, Homo sapiens
  misc_feature 5: n = A,T,C or G
taacnaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatca

SEQ ID NO: 54983 - DNA, 456 bp, Homo sapiens
ggcgccccgtggttcaatccaagatggcggccaccatgaagaaggcggctgcagaagacgtgaatgctactttcgaagatcagcaaaaaataaacaaatttgctcggaatacgagtcgaatcacagagctaaaggaggaaatagaaatgaagaagaaacatctccagaacttagaggacgcctgtgatgacatcatgctggcagatgacgactgcttaatgattccctaccagatcggagacgttttcatcagccactctcaagaagaaacacaggaaatgttagaagatgcaaagaaaactttgcaagaagagattgatgccttagagtccagagtggcgtccatccagcgggtgttagccgacctgaaggtgcagctatacgcgaaatttggcagcaacataaacctcgaggcagatgaaagctaaacattttataatacttttttttatcttg

SEQ ID NO: 54984 - DNA, 372 bp, Homo sapiens
  misc_feature 220, 275, 349, 369: n = A,T,C or G
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgagagaaaggactacagagccccgaattaataccantagaagggcaatgcttttanatt

SEQ ID NO: 54985 - DNA, 481 bp, Homo sapiens
gaacatgtacagagttttatactaaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaaggagggttgcctacagattagtaagcaattccttggatcttatgcacagaacttgtaccatttgaatctgttttatgcttaaatcaaagtgctttgatcaaatgcataacctgccatatctttcatatttggttggtagcaatttgtatttaaaagaaatcacaagtgcaaataaaaagtcatttatcattttgtttaactaaact

SEQ ID NO: 54986 - DNA, 480 bp, Homo sapiens
  misc_feature 18, 21, 345: n = A,T,C or G
taaccaaaaatggtatantanaattacaggtatagattcccccctaacattttattaagcagtattaagaaaatgtagcaatattgaaatgattttacaatgaaacttgtatatccatcacctggattctgacattaatatatatcatactgatttattacatatctgttcatctgttcattcatcagtgcatcttgttttttgatggatttcaaagtaagttgcagataccagtatacttctccctgaatacttcaacatgtgcatgttattaactagaattcacaaatacagatttttaagttttgcatattcctcatagaagaatctaaacggttgggttgngggtgattcatgcctataatcctagcactttgggaggctgaggtgggccggatcccttgagcccaggagttcaagaccagcctgggcaacatggtgaaaccctgtctctactaaaaatacaagaattagctgggc

SEQ ID NO: 54987 - DNA, 112 bp, Homo sapiens
  misc_feature 83, 102: n = A,T,C or G
ggaggcattgaggcagccagcgcaggggcttctgctgagggggcaggcggagcttgaggaaaccgcagataagtttttttctntttgaaagatagagattantccacctcct

SEQ ID NO: 54988 - DNA, 473 bp, Homo sapiens
  misc_feature 187, 292, 315, 346: n = A,T,C or G
ggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaacnttgaagaacagagaccagaaagagtaaaaccttttatgacagggggctgcagaacaaatcaagcacatccttgctaatttcaaaaactaccagttctttattggngaaacatgaatccagatggcatnggttgctctattggactaccgtgaggatggngtgaccccatatatgatttctttaaggatggttagaaatggaaaatgttaacaaatgtgcaattattttggatctatcacctgtcatcataactggcttctgcttgcatccacacaacaccaggact

SEQ ID NO: 54989 - DNA, 302 bp, Homo sapiens
  misc_feature 11, 16, 38, 59: n = A,T,C or G
tgacctgaaanaagancacgagccgaaatgaatttaantagaaccttgattgttgagancgcccttgctagaggtagagtttgatcatagaattgtgctggtcatacattttgtggtctgactccttggggtcctttccccggagtacctattgtagataacactatggggtggggcactcctttcttgcactattccacagggataccttaattctttgtttcctctttacctgttcaaaattccatttacttgatcattctcagtatccactgtctatgtacaataaaagggatgtttat

SEQ ID NO: 54990 - DNA, 428 bp, Homo sapiens
  misc_feature 6, 7, 422: n = A,T,C or G
tcggcnntttattggccggggtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtattgttttttctgtataacagccttttccttctggttctaactgctgttaaaattaatatatcattatcttttgctgttattgacggcgatataatttttattacatatgattagaggggatgagacagacattcacctgtatatttctttttaatgggcacaaaatgggcccttgcctctaaatagcactttttggggntcaaga

SEQ ID NO: 54991 - DNA, 474 bp, Homo sapiens
  misc_feature 15, 309, 462, 468: n = A,T,C or G
caacaacatagcttnaattacagatgacacattctgcaaggctaatgacaccagttacattccgggaccgcattgaagagatacgcctggagggcaatccaatcgtcctgggaaagcatccaaacagttttatttgcttaaaaagattaccgatagggtcatacttttaacctctattggtacaacatataaaatgaaagtacacctacactaatagtctgtctcaacaatgagtaaaggaacttaagtatttggtttaatattaaccttgtatctcatttttgaaggaatttaatatttttaagcaanggatgttcaaaatcttacatataataagtaaaaagtaagactgaatgtctacgttcgaaacaaagtaatatgaaaatatttaaacagcattacaaaatcctagtttatactagactaccatttaaaaatcatgtttttattttaaaatgtccnaatttngagatg

SEQ ID NO: 54992 - DNA, 408 bp, Homo sapiens
  misc_feature 2, 35: n = A,T,C or G
tntggcccgggggagccttgaggaaacccgcaganaagtttttttctctttgaaagatagagattaatacaactacttaaaaaatattagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggc

SEQ ID NO: 54993 - DNA, 337 bp, Homo sapiens
  misc_feature 1, 28, 29, 30, 336: n = A,T,C or G
ntggcccgggccaaaacggaaaagtaannnaagccaggaggagagggaggatgaccaaagaccagtgacccaggaaacctgttgattgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgatttttttttttaacattttaagcagactgctaaactgttctctgtataagttatggtatgcatganc

SEQ ID NO: 54994 - DNA, 414 bp, Homo sapiens
  misc_feature 7, 33: n = A,T,C or G
tcggccnttatggcccggggccaaaaagagtantcttggtgtgaccacctcctctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtaagaagtgc

SEQ ID NO: 54995 - DNA, 414 bp, Homo sapiens
cttacaaaaatggagtattttagtatgaatttgctgaatgtaagaccgtggactgtttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgc

SEQ ID NO: 54996 - DNA, 283 bp, Homo sapiens
  misc_feature 10: n = A,T,C or G
ataaccaagnaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagtgcttgattcaatagaaaaatacagcaaacttttaataacagtctctctacatgacttaaggaacttatctatggatattagtaacatttttctaccatttgtccgtaataaaccatacttgct

SEQ ID NO: 54997 - DNA, 268 bp, Homo sapiens
  misc_feature 206, 249: n = A,T,C or G
gatcctcttgtggaatggagtaaaccagtgtaagggcattccaaagcgccactgaatgaaactggagaagttgtcaatgaaaaggccaagacccatgttcttgacattgagcagcgactacaaggtgtaatcaagactcgaaatagagtgacaggactgcccgttatctattgaaggacatgtgcattaccttatacaagaagctnctgatggaaaacttactatgccagaatgtatcttgggtgggcnctccatatatgtgaaaatg

SEQ ID NO: 54998 - DNA, 166 bp, Homo sapiens
  misc_feature 4, 30: n = A,T,C or G
tttncactatgtagtgatttcagaaagttnattattgcttagtctgctgtgtttagttcccttcaaggttttgtaaaagagacaaaagcttttatttcttggtaggtaaagcatgttgaagttatccatttactctttttttcctttttttctttcctttctttct

SEQ ID NO: 54999 - DNA, 355 bp, Homo sapiens
  misc_feature 6, 219, 274: n = A,T,C or G
gaggcnttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgagagaaaggactacagagccccgaattaataccaatagaagg

SEQ ID NO: 55000 - DNA, 126 bp, Homo sapiens
  misc_feature 6: n = A,T,C or G
gagaantaagatgtgttagaaataattatatgcaaaagtttacagggatgatgtttttaatttttggatgctgaaatgttaatgatccaattatttgaaaaatctactgatatatactccctcatt

SEQ ID NO: 55001 - DNA, 404 bp, Homo sapiens
  misc_feature 31: n = A,T,C or G
gctttccctggtgtgattccgtcctgcgcgnttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaagg

SEQ ID NO: 55002 - DNA, 351 bp, Homo sapiens
  misc_feature 20, 31, 32, 157, 231, 256: n = A,T,C or G
caaggcgtcagcataacagnatgcagaacanntcatatttgaagaatgttttgtactaaacttcatttaattattcagtttttaaagggaaaaagggcgtgagctcacacagtgagctgtttatttaaatatcattaaggagaaaaaaaaatatggngagaagctcgctcctttcaacttgtttggtactgacagctgatagaagctattttctaataataaacatccagngtgtgaaagacaaaacccactgatngcaatactctttttttaatgataaaacctgtgaagtttcccaaagcaggttttaaaaggaaaaaaaggaaaagcaaaaaggttgctgttctcact

SEQ ID NO: 55003 - DNA, 304 bp, Homo sapiens
  misc_feature 15: n = A,T,C or G
ggcagcaacgcggangaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaag

SEQ ID NO: 55004 - DNA, 489 bp, Homo sapiens
  misc_feature 2, 42, 44, 68, 95: n = A,T,C or G
tntggcggggtgtcatctgctaaaaaataaataaaagctagntnctggaaacctaactgcaatgtggntgttttacccacatgacttattatgcntaaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatg

SEQ ID NO: 55005 - DNA, 490 bp, Homo sapiens
  misc_feature 165, 349, 427, 429, 440, 475: n = A,T,C or G
agtaacaataatttctgaacccgagcacaggtctttggaaataacctagtaattttttaaaaggctaaaaaagcctgaatgacaaatggaacactgtaaagcagccaaatatttgaattttgaaaatttcagaagagttgggcaaaggcataaaaaaaaaacctntttaagaaaatactagctgaaagcttcccaactcttgcaagacgtagagacgttaagataccagaagctcaaagaaccccacggacattcaacccgaaaaggtctcctccaaggcacttcatagtcaaatttttaaaaatcagagacagaagtctaaaaagagcaagaggaaaggatcaagtcncacataagggaatctccatcagaccaatggcagattcctaatcaaaaaccttacaggccaggagcgaatatgggggtntnttcaaactgcngataaaccagtagaaatgctgactgaggatacatnccccaagcaaatcta

SEQ ID NO: 55006 - DNA, 289 bp, Homo sapiens
  misc_feature 3, 14, 28, 54, 204: n = A,T,C or G
tcncctaatttttnagcttaatcctctntgcttattatttacataacaataacnttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagnattatattactggatgtttaatttacaaaatagttgggtaaatgttccaacaaactttaaagtaccttgaagtcaaattgtctgt

SEQ ID NO: 55007 - DNA, 490 bp, Homo sapiens
  misc_feature 6, 17, 33: n = A,T,C or G
gtgagnttagactgagnaaatacatctctgttntttataagctgctcagtctatggccttttgttatagcagcccatgctaatgaatacagatgaccgtgtgtctgcagaccttcctaggaaattattgagtccttcattgaatactaaactgtgaatacatgagagaaaataacagaagcctggggtaaaatgccaacacaaagggtttgaagaacaatgctcaaagctcaagaaagctctgcaaatattattgttgccacaaaccaaagtagaagacagggtaatatatgagctattaggtagaatctttggaagaatcctgcttttgtgatggaactcactcattcctaaacctaaagcaactctacatcttctctaagaaaattttatagcaatctctaaaagcatcaaactgattccaaataatttaactgtgtttgagaacaaaatacaaatatacaaaaggaattcaacaaaatccatcacat

SEQ ID NO: 55008 - DNA, 497 bp, Homo sapiens
  misc_feature 25, 495: n = A,T,C or G
tgcatttgtaagatcttagccatgnaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacaggaacaggtgattttctcagcagaacagacttatgagttgatgcggtgtcttggaggacttgacgtcaagaagacctgtgcatggagaatctgataccgagcagctccaggatgatgacatagagaccaccaaggngg

SEQ ID NO: 55009 - DNA, 256 bp, Homo sapiens
  misc_feature 6, 22: n = A,T,C or G
gtatantaattacatcacaagnacgtcttgctctcatgagctgtccccacattaggcttaaaaacagatgcaattccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagag

SEQ ID NO: 55010 - DNA, 139 bp, Homo sapiens
actcccctttttaaagacccttttgttttttgatttatatactctgttttacagatttagctagaaaaaaaatgtcagtgttttggtgcacctttttgaaatgcaaaactaggaaaaggttaaactggatttttttttg

SEQ ID NO: 55011 - DNA, 470 bp, Homo sapiens
  misc_feature 10: n = A,T,C or G
tattcacagnattacatgatcttgcatattaaaaatcctaaggaattaataaaaaactattagaactaataaatgagctcaggtcagttgcagaatagaagatcaatatataaaaatcagttgtatttctatacagagacaaagaacaatccaaaaatgaaattaaaaaaatttcattaacaatagcataacaaatttttaggaataaacttaaagaagtgtaaaatgtatacactgagaaatataaaacatcattgaaagaaattaaggaaacacctaaataaatggaaagatatctcatagaggacttcatatttttaagatggcaatactccttaattgatctgtatgttcaatgcaattcctactgaattcctaaatgtctttattgcagaaattgacaggttaatcataaatttatataaaaagcaaagggacttagcatagctaaaacaatcttgaaacaatac

SEQ ID NO: 55012 - DNA, 383 bp, Homo sapiens
  misc_feature 33, 42: n = A,T,C or G
gtttcctttcggccggaaccgccatcttccagnaattcgccnaaatgacgaacacaaagggaaagaggagaggcgcccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgat

SEQ ID NO: 55013 - DNA, 231 bp, Homo sapiens
  misc_feature 226, 227, 229: n = A,T,C or G
ctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaatnnanga

SEQ ID NO: 55014 - DNA, 274 bp, Homo sapiens
ggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgacc

SEQ ID NO: 55015 - DNA, 459 bp, Homo sapiens
  misc_feature 6, 18: n = A,T,C or G
cctctntagttactaagnaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttc

SEQ ID NO: 55016 - DNA, 220 bp, Homo sapiens
  misc_feature 2, 25, 28: n = A,T,C or G
gnagggctaggactgggatgggaanttngagggaataaaaaggagatagggctctccagagagacaagaaggtaaagattcaacaagggaagctaagaagtcacagactgggagacagaggcaaatgagaaatgtatggataacagatctcaaatctagtttaacctcttccccaccttcccatccccatacaggtcaggctttgacacaaggaatttag

SEQ ID NO: 55017 - DNA, 139 bp, Homo sapiens
  misc_feature 4, 14, 15: n = A,T,C or G
acgncaaggaatcnnactaaagtctagggtttgaaaataattttaagtctttgtttgcagtgaggtattttaggatgagaattatgggcttatttcaatgtgctcttccaaaccatgttatcatctgtctattgatgct

SEQ ID NO: 55018 - DNA, 479 bp, Homo sapiens
  misc_feature 32: n = A,T,C or G
gaagtgcgaaatcttcagaagaagaatttctntttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgagggaggttgttttagctctgctaaaaactccagcgcaatttgatgctgatgaacttcgtgctgccatgaagggccttggaactgatga

SEQ ID NO: 55019 - DNA, 460 bp, Homo sapiens
  misc_feature 31: n = A,T,C or G
gttctttttgaggaagacgcggtcgtaaggnctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgagg

SEQ ID NO: 55020 - DNA, 356 bp, Homo sapiens
aaatggtacaggggaaaactggttagtcatattcagaagaaaactggacccctacctctcaccatataaagaatataactcgagattaaaggccgggtgtggtggcttacgcctgtaatcctagcactttgggaggctgaggtgggcagatcacgaggtcaagagatcgagaccatcctggctaacatggtgaaacccccatctctactaaaaaaacagaaattatccaggcatggtggcgggctcctgtaattccagctacttgggaggctgaggcaggagaattgcttgaacctgggaggcagtttgcagtgagctgagatcacgccactgcactccacctgggcaacaagaac

SEQ ID NO: 55021 - DNA, 342 bp, Homo sapiens
aaaacagatgcaaatcgataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtataagtttgtattcaatttgaga

SEQ ID NO: 55022 - DNA, 298 bp, Homo sapiens
ggggtgaggtgactgccaatgtggatagtaaatttagggtgattgaaagtcctgaaatagattacagtgatagttctataactctataaatgcactaaataatgttgaagtgtacactttaaatagataaacttcatgatatgtaagttttatctcgactaaactcttaaaagggattgaagcaataaaaagcatatagaatattttctctcttgattttacatttatcatttggatattacctgttttaaaataatagcagcctgggcaacatggtgaaacttcatctctaccaaag

SEQ ID NO: 55023 - DNA, 345 bp, Homo sapiens
attggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatg

SEQ ID NO: 55024 - DNA, 350 bp, Homo sapiens
gaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttacagctaactgtgtgccttagaaaccaggtaatattttccttttacttagtgaatattctgctaatatctgcacttttcatgtgggaaagg

SEQ ID NO: 55025 - DNA, 393 bp, Homo sapiens
  misc_feature 27: n = A,T,C or G
gcagaaaggctgaaaattccaaaaatngaactcctcttcttctccaaaggaacataactcctcaccagcaagggaacaaaactggatggagaatgagtttgacgagttgacagaagtagacttcagaaggtcagtaataacaaacatctctgagctaaaagaccatgttctaacccatcacaaggaagctaaaaaccttgaaaaaggttagaagaatggctaactgaataaacagtgtaggagaagagcttaaatgacccaatggagctgaaaacaacagtacgagaattgtgtgaagcatacacaagattcaatagccaattcaatcaagcaaaagaaaggatatcagtgattgaagatcaaattaatgaaataaagtgagaagacaagatt

SEQ ID NO: 55026 - DNA, 412 bp, Homo sapiens
gattgtttttaagtctgtattttcttttgaaatgtagaattgagaatcagtcctctaagaggcccacttagagtaaaatgctcaaaccagtggtcctatttgaagttacctccttaataatttagaaaactcagtggtgaatttcatatatgacaagtgaattttttagcaaaggcattaagatatatttaagtagatttgacagcaacagcctgtgatgttggtttcaaaacagatttcacgaaagtcatcttaacttcacctaagggtgtatgacatctcatttatatgcaattgtccaattattttattgtcaaattttgttgaaacacatttcccatgttgatttctcagatcccttccagctcttacacacaatatgttgatagctgtgagttttcatccagcaaga

SEQ ID NO: 55027 - DNA, 413 bp, Homo sapiens
gcattgaggcagccagcgcaggggcttctgctgagggggcaggcggagcttgaggaaaccgcagataagtctttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttg

SEQ ID NO: 55028 - DNA, 207 bp, Homo sapiens
  misc_feature 19: n = A,T,C or G
gtagataaaaccacaaagnatggggaaaaaacagagtagaaaaactggaaactctaaaaagcagagtgcctctcctcctccaaacgaacgcagttcctcaccagcaacggaacaaagctggatggagaatgactttgacaagttgagagaagaaggcttcagatgatcaaactactctgagctacaggaggaaattcaaaacaaagg

SEQ ID NO: 55029 - DNA, 294 bp, Homo sapiens
ggggggcaggcaccccatgagtctgtccagccttgtcacagatgcatcgcccagcctgcggtcctgatttcagctcacctcagagtaaatcagaataaactgcacccagactttcacgaatgcatgttgacgctttcagttcacccctttctttgctaactttcttcctattttcttctaatgcgagagcttattaattccatatttatcattttgaataacttttctcctttttagtaacaaaatgtacttcactcttagtaaaatgtatttactatttttagtaacaaaatt

SEQ ID NO: 55030 - DNA, 474 bp, Homo sapiens
  misc_feature 418: n = A,T,C or G
acctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaagggtgttgtcacatcaacctaaagagaaccatctatggaaggtntggttgaaacatctgtagggacacagaactgggatttcactgagtttaccaaatca

SEQ ID NO: 55031 - DNA, 468 bp, Homo sapiens
  misc_feature 306: n = A,T,C or G
gctgatagaagagcatttcatcatcttgtttgtgtttgtaaacaatttatacatgcagttagtgaccagccacctcccattaggaaagccaatagacacaaacctgaaggacagatttggtatacttgttacttaaattgtaggttgaactttggggtttttttgttcattgtttttgttgctgctgttaaagtgaatattctacagagtagaaaactaaggtttaagaaagttgtaaaattacttttattttaaataaattataaaattttaacatgagataaaattcaaagacagttaccacanttccctcaagattggcggcaagagtttttgtatgaaacatttgagttttctgtgatcatcagaatcttttagcttttcctttcagccttgactcttattttaatgtatactacattacatttgtataactttctctcatttagctctcaaaacaatggagat

SEQ ID NO: 55032 - DNA, 407 bp, Homo sapiens
  misc_feature 2, 11, 32, 41: n = A,T,C or G
tncttggatanagacacacccagggcagctgncaatcaganatgcaaattgctaaattccaaacagaaccagtgactttgctgctacatatttactaaattgaccactttgattcttgcttgtttgtctcagttatagggagttttgtacatggtgcctcttgttttccatcttcatgcccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtga

SEQ ID NO: 55033 - DNA, 472 bp, Homo sapiens
  misc_feature 9: n = A,T,C or G
catctttcnatccgagaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatc

SEQ ID NO: 55034 - DNA, 285 bp, Homo sapiens
aataaaagcggccgcaggaactgccagtgagagcagtcagatattgtctttaacagacaaagacttcaaagtaactattataaatatagaactaaaggaatgtgtgataaatgaagaaaacgaaagtatggtggcaatagggaaagaaattttatgaaaagaaccaaatggaaattttgctgagttgaaaatttcaccagaggggcccattagtggattagaactggcagaagaaagaattagcaaacttgaaaatagatcaatacagatcatacaatctaaagc

SEQ ID NO: 55035 - DNA, 471 bp, Homo sapiens
gcattgaggcagccagcgcaggggcttctgctgagggggcaggcggagcttgaggaaaccgcagataagtttttttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgatt

SEQ ID NO: 55036 - DNA, 294 bp, Homo sapiens
atagtccattatatgatctgactaattgtgtttaaccctttcttgtaatatacaacattactttccactgttctaactcttccttcaggttgtgggggaggagagaggaaaacagttgccctcaagcgtgaaggtaggtcaggcccatagtaagataagcaagtatttgattattgcttcagtactagtgtcatcaaattaatacagtttcttttacatttaagaaaatacagtttactatcaataaatagtacaaataacaggtgattcagacaacccgccccccaccacaca

SEQ ID NO: 55037 - DNA, 473 bp, Homo sapiens
aaggaaacaagccgaaaaatgctaggtgtgatgtgtcatgaaggaggcatggataaggaaaaactgccaagttcaggaatgatttcatcaacttaagggcaataacaaactaaacacacaataaactttaaaatacatttccatttttaatttaaaaaataaataacagcaaatctgaacaaaattttcctacttcaatgcacatcttcctaactgtccatgtttgaaatccagatagcaacaaaatcatggcaaaggcatttttgacaaagtttagacaaacgactcacaaaatatggctaatagtagatgaagtttggacatctgatactgcagaccagccttggctagatcctaggcgtcagagtgaaatcatgaatttccttttgtagattagaatttggatggtccaactctcaacccaccaaagagaaacttaccttttccaatttaattgtaaaagccagatatat

SEQ ID NO: 55038 - DNA, 479 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataattttgaaggcgatcttttaaaaagagattaaaccgaaggtgattaaaag

SEQ ID NO: 55039 - DNA, 473 bp, Homo sapiens
ctagtatataccttttaatacttttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccat

SEQ ID NO: 55040 - DNA, 291 bp, Homo sapiens
  misc_feature 3: n = A,T,C or G
gtntccgagtggagagagcgagctgagtggttgtgtggtcgcgtctcggaaaccggtagcgcttgcagcaatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 55041 - DNA, 474 bp, Homo sapiens
gcttttcgcctcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctg

SEQ ID NO: 55042 - DNA, 472 bp, Homo sapiens
gtaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtattttagaataagaatttgcatacttacctagtgaaacttttctagaattatttttcactctaagtcatgtatgtttctctttgattatttgcatgttatgtttaataagctactagcaaaataaaacatagca

SEQ ID NO: 55043 - DNA, 125 bp, Homo sapiens
  misc_feature 3, 29, 90, 97, 105: n = A,T,C or G
ggntgccccatgtgagaacacaccaccanaaagaattgcctgtgagtcctggtcatcggaaaacccccttcacaaaagacaaacattcangccgctnggaggctnatctcacaagagatgaactt

SEQ ID NO: 55044 - DNA, 471 bp, Homo sapiens
  misc_feature 439: n = A,T,C or G
caaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttagggtttnaagatgaccaatgacaatgaccacctttgcag

SEQ ID NO: 55045 - DNA, 327 bp, Homo sapiens
tgatgcaaacgcagcagaacttgccacatcagactcagattccccaacagcagactgcaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctctga

SEQ ID NO: 55046 - DNA, 474 bp, Homo sapiens
atttagggtgggtagaaagccccttgttacaaattttttaatttccaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttggaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctt

SEQ ID NO: 55047 - DNA, 474 bp, Homo sapiens
gaactcggtggtggccactgcgcagaccagacttcgctcgtactcgtgcgtctcgcttcgcttttcctccgcaaccatgtctgacaaacccgatatggctgagatcgagaaattcgataagtcgaaactgaagaagacagagacgcaagaggaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaagaagtggggggggacg

SEQ ID NO: 55048 - DNA, 484 bp, Homo sapiens
  misc_feature 3, 36, 47, 465: n = A,T,C or G
ccngggaattcggccttatggccgagaagttgaatnatttgaaaatntgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtnatagtagttgccattttgt

SEQ ID NO: 55049 - DNA, 363 bp, Homo sapiens
ggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccactggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagcctgttgtacattttaagaataaacttttg

SEQ ID NO: 55050 - DNA, 228 bp, Homo sapiens
  misc_feature 21: n = A,T,C or G
ggtgggcaggtacttaaggtnggagttccagaccagcctggccaatatggtgaaaccctgtctctactaaaaatacaaaaactagctgggcatggtggcagggcgcctgtagtcccagctactcaggaggctgaggcaggagaatcgcttgaacctgggacatggaagttgcagtgagctgagatcacaccactgcactccaacctgggagacagagcgagactccgt

SEQ ID NO: 55051 - DNA, 471 bp, Homo sapiens
  misc_feature 261, 296, 435: n = A,T,C or G
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggngggagatgaagcttcttcatggagtaaaaaatgtntttaaaagaaaattgagagaaaggactacagagccccgaattaataccaatagaagggcaatgcttttagattaaaatgaaggtgacttaaacagcttaaagtttagtttaaaagttgtagggtgattaaaataatttngaaggcgatcttttaaaaagagattaaaccgaaggt

SEQ ID NO: 55052 - DNA, 367 bp, Homo sapiens
  misc_feature 6, 20, 39, 325: n = A,T,C or G
cccccngggaaatttcggcnctttattgggccgggtatntaccctaggagtatacacctcaagtgtatttaaacattttacagagttcagtgcacatctcctcagtcctgagccttatgagttatctgactgttaaccccgaaaggtacacactggatctccttcactcattttttaaccctgactgggacaccagagacatgctgcatcttgtattagggtgtttcatcttgcagaatggctgtgctcctgaaatatttcctgtgaagaaaattgttacaatcccattacatcactggcttttattattaaattgggaaattgnttggctgggaaacaattttaaccccaaattgtgaaaataaat

SEQ ID NO: 55053 - DNA, 472 bp, Homo sapiens
  misc_feature 427, 430: n = A,T,C or G
cagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttttgggntgnaataattccaagttcactcacccaatgtacaaccaatgaaat

SEQ ID NO: 55054 - DNA, 466 bp, Homo sapiens
ggaaacaagatggcgggttcgtggtgagaagccgtcaagcaggagtagaaattggtatgcttaaaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattcccatatgaacacacaaaacctatccctcggccagatcctgtgcataataatgaagaaacacatgatcaagtgctgaaaaccagattggaagaaaaagttgaacaccttgaggaaggacctatgataga

SEQ ID NO: 55055 - DNA, 474 bp, Homo sapiens
gattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgttttttagatgtcctttgtccaatgtgaacatttattcatattgtttttgattaccctcgtgttactacaagatggcaataaatactatggga

SEQ ID NO: 55056 - DNA, 303 bp, Homo sapiens
  misc_feature 262, 302: n = A,T,C or G
gaattcaatagtaacatttggtttcaatcttatggttagttcaaccacgtgtattgatcttctactaggtgccaagaactttgatagttgctttacatatattctgacttagtctttacaatatccttgtaagtgtaggtatgataaaataattcatgttttcacagttttgggggattagatctaagagtagtaagattacaatattatagagaagtagggttccagagctggaattcaaactcaggtctttctgaccagnaagtttcaagttcctcctattttttaaaattttttacccng

SEQ ID NO: 55057 - DNA, 474 bp, Homo sapiens
ggtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaat

SEQ ID NO: 55058 - DNA, 471 bp, Homo sapiens
  misc_feature 433: n = A,T,C or G
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttngaaggcgatcttttaaaaagagattaaaccgaaggtga

SEQ ID NO: 55059 - DNA, 427 bp, Homo sapiens
gaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaacgaagtcaaactgtgccacacatggtg

SEQ ID NO: 55060 - DNA, 449 bp, Homo sapiens
attccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttaga

SEQ ID NO: 55061 - DNA, 471 bp, Homo sapiens
tgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaattttgaggactacctaaatgcagaatcacgagtgaacagacgtcagatgcctgataacagggtgcagtgtt

SEQ ID NO: 55062 - DNA, 197 bp, Homo sapiens
caaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaatt

SEQ ID NO: 55063 - DNA, 474 bp, Homo sapiens
atacaaattaaggtaatatcaaatcggctgtttcaaaatgttcttttttaccccttatcattctgacacacatccctaagagggatcattttaaaaaatatataagaatattaaaataatttcattttaattctggtagtaagatggtagcaggttagatctgagtcttctctcctctcttggactctacgcagtaaggaaaacagcaacaacaaaattcgtgaactccatttccagggaaatagcaagataaatttcaaattgtgtaagtgttgattaaagcagctgaggctgacaaagcctttcagaaatccctgcggaaagaggcaacagaagcagcagtagactatgaaaaatggggtggcatgctgggggttatagctagtggtagggaaacttagcaagtgccagaaaaaaaatgtacaccttctatataggaactatgtattctttggtgatagtggccatgaggac

SEQ ID NO: 55064 - DNA, 461 bp, Homo sapiens
  misc_feature 458, 461: n = A,T,C or G
gacaactcggtggtggccactgcgcagaccagacttcgctcgtactcgtgcgcctcgcattgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggnaan

SEQ ID NO: 55065 - DNA, 275 bp, Homo sapiens
gggcgcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcgggg

SEQ ID NO: 55066 - DNA, 137 bp, Homo sapiens
  misc_feature 71, 137: n = A,T,C or G
ctgtccaagtgtatctttcactgatttctgaatcatgttctagttgcttgaccctgccacatgggtccagngttcatctgagcataactgtactaaatcctttttccatatcagtataataaaggagtgatgtgcgn

SEQ ID NO: 55067 - DNA, 468 bp, Homo sapiens
  misc_feature 18: n = A,T,C or G
ggtcgtggaggaaacttngtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggc

SEQ ID NO: 55068 - DNA, 118 bp, Homo sapiens
gctaaacctagccccaaacccactccaccttactaccagacaaccttagccaaaccatttacccaaataaagtataggcgatagaaattgaaacctggcgcaatagatatagtaccgc

SEQ ID NO: 55069 - DNA, 458 bp, Homo sapiens
atattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataattaaagggtaattatatgcatgtatggatttcctaataatt

SEQ ID NO: 55070 - DNA, 469 bp, Homo sapiens
aggcaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgattcggtttttgtgat

SEQ ID NO: 55071 - DNA, 252 bp, Homo sapiens
  misc_feature 39: n = A,T,C or G
gggatgtgcctgttcaggtcctttgcccatcttttaatnggtttttttttgctgttgagttgtttgacttctgcatacattttggatcttaatctcttatcatatatatggttgcaaatattttctctcattctacaagatgtctcttcactttgttgattgtttccttttctgtgcagaagctttttagcttgacataatttcattcgttcatttttgcttttgttacctgtgcttttgaggtcatatccc

SEQ ID NO: 55072 - DNA, 467 bp, Homo sapiens
cagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatttggatgatgaagatgatgacgaccatgtgggacagccaggactccattgactcgaacgactctgatgatgtagatgacactgatgattctcaccagtctgatgagt

SEQ ID NO: 55073 - DNA, 335 bp, Homo sapiens
  misc_feature 6, 9, 20, 65, 318, 319: n = A,T,C or G
gcaatnaanaaaaacatttntttttctacctttgtattgaacgtaattttatttttttaataacnacactcactagatggttttgattgttccagttgtgtgattgtgtatgtacgcataggaatgttttgttcagttgtactttgtatttccaataatcagaaatcttacctttatgtataaaaacccattatgtaatgtaaaatgtataatattgtacataatattcagaatacaattattttggtaaaattagcttgtatttttaatgtcccagttgcagtatttaattattttgaacccatactgaaaggtggnnaataggccaataaagc

SEQ ID NO: 55074 - DNA, 284 bp, Homo sapiens
attaggaaaagaatgaaagatatcttctactcttcccaaatgttctgctaatgttgtctgccagtcctaggatgagtggctttatccatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttc

SEQ ID NO: 55075 - DNA, 469 bp, Homo sapiens
  misc_feature 411: n = A,T,C or G
tatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggngtcgaactcctgggctcaggcgatccttctgccttggcctcccgaagtgctgggattg

SEQ ID NO: 55076 - DNA, 474 bp, Homo sapiens
  misc_feature 418: n = A,T,C or G
gccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatgggttgagttacattaaaataaaccaaatatgttaaagttttaagtgtgcagccatagtttgggtatttttnggttatatgccctcaagtaaaagaaaagccgaaagggttaatcatattttgaaaac

SEQ ID NO: 55077 - DNA, 205 bp, Homo sapiens
aagatctgggatttagagggaaagatcattgtagatgaactgaagcaagaagttatcagtaccagcagcaaggcagaaccaccccagtgcacctccctggccaggtctgctgatggccagactctgtttgctggctacacggacaacctggtgcgagtgtggcaggtgaccattggcacacgctagaagtttatggcagagcttt

SEQ ID NO: 55078 - DNA, 474 bp, Homo sapiens
  misc_feature 10, 14: n = A,T,C or G
gaaaaaagtnaagnaaaaattgtatttgagggaaaaaaccatgaccaagtaaaggataaattcaaaaaatagcctcatgagacttggcatacacactcatgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagtt

SEQ ID NO: 55079 - DNA, 100 bp, Homo sapiens
  misc_feature 95, 96: n = A,T,C or G
atcgtagagtgaacacaacccaaaaacgatacgccatctgttctgccctggctgcctcagccctaccagcactggtcatgtctaaaggtcatcgnnttga

SEQ ID NO: 55080 - DNA, 364 bp, Homo sapiens
attccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctagctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgc

SEQ ID NO: 55081 - DNA, 405 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttt

SEQ ID NO: 55082 - DNA, 217 bp, Homo sapiens
atttggttttaattttctttaccctgattaccaaaaggttgtagctttttatttgtttgttttttagccacttggatatcctcctttgtgaagtgccttttcaataatttgtccaccttcctattgggtcacctgtcttttcttaacaatttaaaagtattttctatgtatctggatcttatttgtctttatgtcctataaatatattttcccattc

SEQ ID NO: 55083 - DNA, 274 bp, Homo sapiens
acctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacgcaatggtgctattctgtgtcaaacacctctgtattttttaaaacatcaattgatattaaaaatgaaaagattattggaaag

SEQ ID NO: 55084 - DNA, 436 bp, Homo sapiens
  misc_feature 47: n = A,T,C or G
ggcgactgagcggacaaacggaagtgtaggttacggtctgagacatnaccgccaagctgggcatcggggagatggccgagactgaccccaagaccgtgcaggacctcacctcggtggtgtagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaaagtatgcattcttatcacctagtatat

SEQ ID NO: 55085 - DNA, 376 bp, Homo sapiens
ctaaagtagtcttgaaagaagatcagagtggaagaactttctctattaaaaacttatataaatctacagtcactgatttcatgaaataaagccacaaggataaacaaaagaaattaaatgcctggaaaagggttcacatgtacacggacacttgctttatgacaaaacgcacactttagtagggaaagaattagtcaataaatcgtcctggaacaagtgataatctgtatggaaagaaatgacttatgttccataccatatgcaaacatcagtttaagaatgattcgtatatttcaacatgaaagacaaaactgaaacttttggaagctaatatagatgaacaggttcatgctctttggccaggaaaatatttctt

SEQ ID NO: 55086 - DNA, 427 bp, Homo sapiens
  misc_feature 13, 377: n = A,T,C or G
ccgaaatatttcnttgtttcccttttttgcagagcatgtggaagttaaacctgcttgattctactatacatcttgggcaactagttaccaaatgaattgtgccaccataactgattttaatttcgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatatttgaagacattacaatttagtttggggtggtctttttttaaattgctgtatcngttcagtctcttgtggcaatagcactttgaagaaaatagagaattaatat

SEQ ID NO: 55087 - DNA, 301 bp, Homo sapiens
ggcgcaatagatatagtaccgcaagggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaacc

SEQ ID NO: 55088 - DNA, 432 bp, Homo sapiens
gtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtggggtgggacacccagtgcgaaaccctcatccagttttctctccatctcttttctttgtacaatcccatttcctattaccattctctgcaataaactcaaatcacatgtctgc

SEQ ID NO: 55089 - DNA, 271 bp, Homo sapiens
ggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtac

SEQ ID NO: 55090 - DNA, 500 bp, Homo sapiens
  misc_feature 8, 361: n = A,T,C or G
cccggganttcggcccttatggcccggggaaatgatgagatgaaatgatgaaatgagataagatgaaaagagttgatgagatgatgagatgaaatgagatgaaaagagatgaaatgagatgaaatgaaatgatgagatgaaatgaggtgaaatgaaattagatgaaacgtaatgagatgaaatgacctaatgaaatgaaaaaatgaaatgaaataatgaaatgaggtgaaattaaatgagatgatgaaattaaatgatgaaatgaaataatgaaatggaaatgaaatggaaatgatgagatgaatgatgagatgaaatgatgagatgagatctaatgatgagaggagatgatgagatgaantgagatgaaaagagatgaaatgagatgaaaccgaaatgatgagatgaaatgaggtgaaatgaaattagatgaaacgtaatgagatgaaatgacataatgaaatgaaaaaatgaaatgaaataatgaaatgaggtgaaat

SEQ ID NO: 55091 - DNA, 474 bp, Homo sapiens
gaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttaggtagtttggaagaagaacaagaattccacatgagaagtaaaaacagtttacagtactcagcaaaagaacatggaatgcctgaaaaggtaaaactagttcatttttctttgcttggaaactatgagagaagaacaaaggaaaattttataaaataaggcatacctgaattcccagattttagttgtatttccaagttccccagtaccttgttaaagtaaggagattttttttgttttctctacaggaaaacactggccatttgaacatttgattatctcctaattcagaattgtagtaattcaataaactgtta

SEQ ID NO: 55092 - DNA, 451 bp, Homo sapiens
  misc_feature 295, 352, 379, 381, 400, 420: n = A,T,C or G
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntttaaaagaaaattgagagaaaggactacagagcccccgaattaataccaatagaanggccaatgcttttagattaaaatgaangngacttaaacagcttaaagnttagtttaaaagttggaggngattaaaaaaattttggaaggcgatcttttt

SEQ ID NO: 55093 - DNA, 383 bp, Homo sapiens
  misc_feature 5, 19: n = A,T,C or G
tatgncttatggcgggggntcttatatatagacaacctaaagactttaccaaggaaaaacccttacaactgataaattcagtaaaatatcagaatataatattagtagtattttgatgcatcaatgatgaaaaagctgaaaaagaaatcaggaagacaatcccatttacaataattaaaagataaaatacctcggatctaaccaaaaaggtgaaaggtctctacaagggaaactacaaaacactaatgaaagaaataaacaaatggaaagacattccatgtgcatgaatcagaagaattaatatcattaaaatgtttacccaaagtaaacttgattcaaagcaatctctatcaaaatactattgtcatttgtcacagaaattg

SEQ ID NO: 55094 - DNA, 131 bp, Homo sapiens
  misc_feature 100: n = A,T,C or G
ggcaggcatctgtagtcccagctacttagaaggctgaggcaggagaatggcgtgaactcaggaggcagagcttgcagtgagctaagattgtgccactgcnctccagcctgggggacagagcgagactctgt

SEQ ID NO: 55095 - DNA, 213 bp, Homo sapiens
atgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttaac

SEQ ID NO: 55096 - DNA, 177 bp, Homo sapiens
  misc_feature 164: n = A,T,C or G
gggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatccgcggttaaagggccttntgctttttaactg

SEQ ID NO: 55097 - DNA, 121 bp, Homo sapiens
tataattttaattcctgattaaaacagtctgtatttgtgtatatcatacattgttttcaataccacttttaattgttactcattttattcactaagctcgataaatctaacagttactctt

SEQ ID NO: 55098 - DNA, 471 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataattttgaaggcgatcttttaaaaagagattaaaccgaaggtg

SEQ ID NO: 55099 - DNA, 257 bp, Homo sapiens
  misc_feature 4, 13, 40: n = A,T,C or G
gtangatattttngacctcaatgcccctatcgtacaattnaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaaga

SEQ ID NO: 55100 - DNA, 281 bp, Homo sapiens
  misc_feature 242, 245, 257: n = A,T,C or G
accgcaagaataaaaaagaaatcctatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcangtntccaaccaactnggttctgcttcaataaatctttgg

SEQ ID NO: 55101 - DNA, 366 bp, Homo sapiens
gatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattgtaaggcctttcttt

SEQ ID NO: 55102 - DNA, 375 bp, Homo sapiens
  misc_feature 8, 19: n = A,T,C or G
ggtaatangctgattaatnctctacaatacttcatgacatggcattgtacctggtctataattattatttgtcaattaaaaataaaataaaatggtcaggtgcggtggctcactcctgtaatcccagcactttgggaggctgaggcgggcagatcacttgacgtcaggagttcaagaccagcctggccaacatggtgaaactctgtctctactaaaaatacaaaaattagcccagcacggtggtgcacacctgtaatcccagctacttgggaagcggaagcacgaggatcgcttgaacatgcgaggcggagcttgcagtgagccaagatcactccactgcactccagcctgggcgacagagggagactccgtttc

SEQ ID NO: 55103 - DNA, 105 bp, Homo sapiens
gatacggtacgtccataaagccgtattacacttaaatgaagtattcttttttgtaatcgttttttttagaaggtaaacaaatttaataaagctaccaataatgtt

SEQ ID NO: 55104 - DNA, 340 bp, Homo sapiens
  misc_feature 51: n = A,T,C or G
atatgtagaaagctgaaactggatcccttccttacaccttatacaaaaatnaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatacccagaatctacaatg

SEQ ID NO: 55105 - DNA, 472 bp, Homo sapiens
gataattgaaaacctacagtctcagctaaagctaagggaaggggagatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgtagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgtttta

SEQ ID NO: 55106 - DNA, 471 bp, Homo sapiens
tgtgaaatcttcgagaagaatttctctttagttctttgcagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaaggttgttttagctctgctaaaaactccagcgcaatttgatgctgatgaacttcgtgctgccatgaagggccttggaactgatg

SEQ ID NO: 55107 - DNA, 384 bp, Homo sapiens; identical to SEQ ID NO: 25723

SEQ ID NO: 55108 - DNA, 108 bp, Homo sapiens
ggggaatagggttcgattccggagagggagcctgagaaacggctaccacatccaaggaaggcagcaggcgcgcaaattacccactcccgacccggggaggtagtgacg

SEQ ID NO: 55109 - DNA, 470 bp, Homo sapiens
gataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttgggaggagcaaagttaaaagcctacctaagcatatcgtaaagctgttcaaaaataactcagacccagtcttgtggatggaaatatagtgctcgagtcacattctg

SEQ ID NO: 55110 - DNA, 370 bp, Homo sapiens
tctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactg

SEQ ID NO: 55111 - DNA, 469 bp, Homo sapiens
  misc_feature 459: n = A,T,C or G
gcttagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggngttggttttt

SEQ ID NO: 55112 - DNA, 162 bp, Homo sapiens
gcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaat

SEQ ID NO: 55113 - DNA, 432 bp, Homo sapiens
ggctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctat

SEQ ID NO: 55114 - DNA, 457 bp, Homo sapiens
  misc_feature 429, 456: n = A,T,C or G
gttggaattatagacaaagactttaaagcattataatagctatgttccatgaagtaagggcacatactcttgaaatgaagggaaagatacaagttttcagcaaataagcaaaaactaaaagaaataaccaaatgaggattttagacctcaaattacaacaactgaaaaaaaagttccctggaattattgaatagcggaatggagataccagaggagatgagaaacgtgaaaatagataaataaaaattatccaaggaaaattttaaaacattttgaacataccaaaatttgtgggatgcaaccaaggcaatgcttataggaaaatatggaacattaaatgctcatattagacaagaaggtctgaaatcaaaatatagtattatacccttaagaagctagaaagagttaaacccaaagtatgtagaaagnaaggaagcaataaagagcagaaatcant

SEQ ID NO: 55115 - DNA, 474 bp, Homo sapiens; identical to SEQ ID NO: 55041

SEQ ID NO: 55116 - DNA, 435 bp, Homo sapiens
atctgggcatggtggcacatgcctgtagtcccacctactcaggaggctgaggtgggaggaccacttgagcccgggaggtggaggttgcagtgagctgtgataaggccacgcactccagcctcgacaacagtgagaacctgtctcaaaaagcgggtggctcatgcctataatcccagtactttgggaggctgaggcaggcgaattgcctgaggtcgggagtttgagaccagcctggccaatatggtgaaaccttgtctctactaaaagtacaaaaattagctgggtgtgatggtgcgtgcctgtagtcccagctactcgggaggctgaggcaggagaattgcttgaacccagaaggcagaggttgcagtgagctgagattgcacaccactgcactccagactgagtaacagagcaagactccgtctcccacctacc

SEQ ID NO: 55117 - DNA, 466 bp, Homo sapiens
gattgaaaacattgatcacctgggtttctttatttatcgactgtgtcatgacaaggaaacttacaaactgcaacgcagagaaactattaagggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtattgaagtcatagataatagtacatgtcaccttaggtagtaggaagaattacaatttctttaaatcatttatctg

SEQ ID NO: 55118 - DNA, 472 bp, Homo sapiens
  misc_feature 460: n = A,T,C or G
attctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttgggtttgggatcaataggaaagcatatgcagccaaccaagatgcaaatgttttgaaatgatatgaccaaaattttaagtanggaaagtcaccc

SEQ ID NO: 55119 - DNA, 324 bp, Homo sapiens
tatgtaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctgggaac

SEQ ID NO: 55120 - DNA, 469 bp, Homo sapiens
ctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatg

SEQ ID NO: 55121 - DNA, 289 bp, Homo sapiens
ggaaccctgtagttattactgaaagagagtgtggatattttaagtatctcctagtataatatgacattgttcatgtggacttattttaatgtttatttgaaaattaattttttaattattttgtatattttgagttagaaaaacacactttatcttagacaccaaagccaaattattccaagtgtatgctataacacccgcagtgcagcctctgctttctctcccaacctaccctggggccatttttggcacaatagttgttcaaatgtagatcactatgctgaaaggc

SEQ ID NO: 55122 - DNA, 303 bp, Homo sapiens
  misc_feature 5, 67, 184, 208, 222: n = A,T,C or G
attcncaagcattgccttcttattttacttcttttagctgtttaactttgtaagatgcaaagaggtnggatcaagtttaaatgactgtgctgcccctttcacatcaaagaactactgacaacgaaggccgcgcctgcctttcccatctgtctatctatctggctggcagggaaggaaagaactngcatgttggtgaaggaagaagtgnggtggaagaagtgnggtgggacgacagtgaaatctagagtaaaaccaagctggcccaaggtgtcctgcaggctgtaatgcagtttaatcagagtg

SEQ ID NO: 55123 - DNA, 474 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggggggacga

SEQ ID NO: 55124 - DNA, 437 bp, Homo sapiens
  misc_feature 11, 12, 25, 42, 61, 76, 82: n = A,T,C or G
taatttaggcnnttatggcgggggngttgggctcaataggcngagcgtatgcagccaaccnagtatgcaacatgtnttgaantgatatgaccaaaattttaggtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacat

SEQ ID NO: 55125 - DNA, 243 bp, Homo sapiens
  misc_feature 9: n = A,T,C or G
gaaaggacnagttcgaatgcctaccaagactttgagaatactacaagaaaaactccttggggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgc

SEQ ID NO: 55126 - DNA, 472 bp, Homo sapiens
ggcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgcc

SEQ ID NO: 55127 - DNA, 292 bp, Homo sapiens
acgtgaagtaaactctttcccgacaaggaaaagctgagataattcatcaccactagattggcctaacaagaaatgattatgctgagtcctacagcaagaagtgaaaagcaggtaattactgtcatgaaaacatcagaaattataaaactcacagatagagataaatttgtaatcaaactcgtaatactccaatactatgatgatgctgtgtaaatctttcagacctcaactctgaaggttgaaagtcaaaatagtaataactacagccacaagtagttgttaaggagcaccc

SEQ ID NO: 55128 - DNA, 474 bp, Homo sapiens
  misc_feature 34: n = A,T,C or G
atagttcgtgtgacaaacagagatatcatttgtnagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgc

SEQ ID NO: 55129 - DNA, 167 bp, Homo sapiens
ctctgctgaaaatagaaaaaattagccaggcatggtggtgcacacctgtggtcccagctgcttgggaggctgaggcatgagaatcatttgaacccgagaggcagaggttgcagtgaactgagatcgcgccactgcaccccagcctgggtgacaaagcaagactctgt

SEQ ID NO: 55130 - DNA, 462 bp, Homo sapiens
  misc_feature 30: n = A,T,C or G
ccagaggtaagtgggatctgtattaaaatngttatacaaatttatcttctgttcattaaactattagaatttaaaataaacatctttattaagttgctcctaaatgaagtgactgcattttattttcaaattaaattcttaagactttatattatacggacctttatatcaaggtagatataaattaactctcaattcacattgagagtcagaatagatgcatcttttattaaaattacctaaagagaaaattgtagctttgaatggttcaatacctaatcagaagatattttttcagattttataattggatttctttccagatttgtctgcatcctgaaaatggccacctttgcacattagtctataatattatattaatgtatgattttcagctggagtccctttctggaagattttgagccaaatctaaattttagagaaattttagaaaaacccatg

SEQ ID NO: 55131 - DNA, 471 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtga

SEQ ID NO: 55132 - DNA, 245 bp, Homo sapiens
gggaataaataaagagcattagtaaaggtaactgcctaagtaaatataaaaggcagaataaaagtatttttaaataaaaggtatccatattagaaaggaaaaagtaaaacaactatttgcagacaacatcatcatgtatatagaaaatattcaggaattcaattaaaaattataaatgagtttatcagggtttcaagatgcaagatatttacaaaactctattatatttctatatactaacaatg

SEQ ID NO: 55133 - DNA, 328 bp, Homo sapiens
gaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctat

SEQ ID NO: 55134 - DNA, 468 bp, Homo sapiens
gtcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaaggaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtgggagatgctccagctgctggtgaagatgcatgaataggtccaaccagctgtacatttgg

SEQ ID NO: 55135 - DNA, 472 bp, Homo sapiens
  misc_feature 11: n = A,T,C or G
aacaataagcngtataaaacacctaaataaccatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttg

SEQ ID NO: 55136 - DNA, 397 bp, Homo sapiens
gttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgctttttttcttggtaaccttg

SEQ ID NO: 55137 - DNA, 128 bp, Homo sapiens
caaaaatgggagacaatttacatggactttggaaaatatttttttcctttgcattcatctctcaaacctagtttttatctttgaccaaccgaacatgaccaaaaaccaaaagtgcattcaaccttacc

SEQ ID NO: 55138 - DNA, 472 bp, Homo sapiens
ctagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtca

SEQ ID NO: 55139 - DNA, 474 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcagggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgc

SEQ ID NO: 55140 - DNA, 472 bp, Homo sapiens
gctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccac

SEQ ID NO: 55141 - DNA, 254 bp, Homo sapiens
gggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactg

SEQ ID NO: 55142 - DNA, 425 bp, Homo sapiens
gcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacg

SEQ ID NO: 55143 - DNA, 281 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggtttcccat

SEQ ID NO: 55144 - DNA, 327 bp, Homo sapiens
aagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagt

SEQ ID NO: 55145 - DNA, 467 bp, Homo sapiens
aactttggaatccttagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtgggtttggacttgggaacaggactttatacctcttttactgtaacaagtactcatta

SEQ ID NO: 55146 - DNA, 473 bp, Homo sapiens
gcctttcggccggaaccgccatcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtaccttgggttcaactaaagcgccagcctgctccacccagagaagcacactttgtgagaaccaat

SEQ ID NO: 55147 - DNA, 473 bp, Homo sapiens
atagacattctacataagcccagttatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatac

SEQ ID NO: 55148 - DNA, 452 bp, Homo sapiens
  misc_feature 7: n = A,T,C or G
gatgagnagttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctgttataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaaggaaaattctgaagccagctatcacaggtttgttagctaat

SEQ ID NO: 55149 - DNA, 147 bp, Homo sapiens
gcatagaataatgaagatctttgttttttgttttcattaaagagccattctggcactttaatgataaaatcccattgtatttaaaacatttcatgtatttctttagaacaacataaaattaaaatttaacatctgcagtgttctgtg

SEQ ID NO: 55150 - DNA, 398 bp, Homo sapiens
gctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcgctgacctcagcagccgattcagcaaaagtcagctggatattataattcatagcttgaagaaatgtgacatctccctgcaattcttcttgcctttctcacttggcaaggaagatggaagtggggacagagggagatggcccctttcgcttaggtggccatgggccttcctttccactaaaaggaattaccgaacagc

SEQ ID NO: 55151 - DNA, 257 bp, Homo sapiens
  misc_feature 187, 240, 242: n = A,T,C or G
tcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaanggaataaaaaatactcaatatgcaaaagtcttgtgaagaaaatgaggggaaancncagaacatgccaaag

SEQ ID NO: 55152 - DNA, 472 bp, Homo sapiens
gttttctttgcattcagaaagataatgctcttaatagattaatttatgagtttggacactcttgagtgggaaaccctcccaacttcaagaaaacaatggacttttggctaaagtagtaaagaggtatgagcctttgaatcagaccagactcttaaattcctccatttaacagatacaaaatcttgagtaatttcttcactcttttgagactctgtttccttatctgtgaaagagctaaaatatttccatctcacagaagtgggaaagacattcattcattcaagtatttttttgttgcacacttactataccagacactttctgggtactgagaatacaaaagtaaacaaaacagcaagaaatgttgtactccatgttaggatataggagtttacattctaatgagataaaaaattggagattgtctatgtgaaataaagcatgctataaaaattattgtatcaggtggagt

SEQ ID NO: 55153 - DNA, 474 bp, Homo sapiens
gtaaacatttttgtaaaatgtagaaatgcatgtaatcagttaagttttatattttacaatgttctgtaaaataaaacttagcgaggtaaatcgaataaaggagcagtcactctctaacagattgtaggagaggtttagttggatttagtctatttgacttgcccttaatttaattttatggcaaatcacaaatgtgtcgaaggtttagcaatataatagcaaagtcctactccagtaaataaaagttgatatgtttgtactaactttcaaagacattatgcgtttttatcattacaaggcatctaattgttcccttcatgtgataaaggtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggt

SEQ ID NO: 55154 - DNA, 474 bp, Homo sapiens
  misc_feature 28, 94: n = A,T,C or G
ggacgctaggaaatttttttttattttnacctttgttacatagcactgaggctacaagatcatagttcatttaaagcccccatccctgcaaggnggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattggatttgtcttctgatagtgaaagatgtcgtttccccaaattgctccaatacagttcaagagaaaacattcaacaaagatacagtgat

SEQ ID NO: 55155 - DNA, 206 bp, Homo sapiens
ggaggaaaagtgggaacaagagtgaaaaactatcaattcttcagccgttctattagtgtatcagtgatgtatttggttgtgctattggggaggtgtttgtagttttaagtattgcaaaatgcttttcatatacacttaaatcaagcttacaactggctattaagttttttccctcttctgttcacaatctgtgtcagcttccattc

SEQ ID NO: 55156 - DNA, 443 bp, Homo sapiens
ggacaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaag

SEQ ID NO: 55157 - DNA, 469 bp, Homo sapiens
  misc_feature 5: n = A,T,C or G
catcnaattaagcttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgag

SEQ ID NO: 55158 - DNA, 454 bp, Homo sapiens
gcattgaggcagccagcgcaggggcttctgctgagggggcaggcggagcttgaggaaaccgcagataagtttttttctctttgaaagatagagattaatacaactacttaaaaaatacagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaaga

SEQ ID NO: 55159 - DNA, 433 bp, Homo sapiens
  misc_feature 11: n = A,T,C or G
gtgtgaaaacngtccctttctcctaggtaatgagtagtgctgttcatattactttagttctatagcatacttgcatctttaacatgctatcatagtacatttagaatgattgcctttgatttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgttagttggttttgaga

SEQ ID NO: 55160 - DNA, 406 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 55161 - DNA, 154 bp, Homo sapiens
aatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcacc

SEQ ID NO: 55162 - DNA, 471 bp, Homo sapiens
ggggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactg

SEQ ID NO: 55163 - DNA, 316 bp, Homo sapiens
  misc_feature 10, 11, 36: n = A,T,C or G
taatttaggnnttatggcgggggctttttataaacnaaactctatctgaaatcccaacaaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataac

SEQ ID NO: 55164 - DNA, 495 bp, Homo sapiens
  misc_feature 7, 11, 219, 321: n = A,T,C or G
taatttnggcnttatggcggggggagcatttaagaaagctcctctgccaagaccaaaggtaaagaagaaaaagggccaaaagccaaaatgaaactgatggtacttgttttcaccattgggctaactttgctgctaggagttcaagccatgcctgaaaatcgcctctcttgctacagaaagatactaaaagatcacaactgtcacaaccttccggaaggngtagcctgacctgacacagattgatgtcaatgtccaggatcatttctgggatgggaagggatgtgagatgatctgttactgcaacttcagcgaattgctctnctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctat

SEQ ID NO: 55165 - DNA, 209 bp, Homo sapiens
  misc_feature 1, 12: n = A,T,C or G
nacaaatatgtngtttgcagttatgcggaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttagg

SEQ ID NO: 55166 - DNA, 469 bp, Homo sapiens
gggggtgtggggacctggtggctgacagccagcattagagctgccaacgcgtttactgtcaggaaaaaatggggactttacacatatgtcttacaaatcctttcttttttacttcaagcctgtctggaagttacttgtggacatggtgagtagcattgttaatgttacaattgtttctgtaaatgaaatggatatcattgatgacatgccttttgatgatcagtaaatatattcaggactatctgttgatcactatagcgatgataaagcaaaaagccaataaaatatgacattccttttctgatatctgacgtaacagatggctgtgctcatgcaggcagggtggcatgaggggaagcagtgagggggtcctgcctcccccactgtgcatgtgtaacacacggtgccagttctctgagcctccattgcctgactatgacaagaggatcatcctaacttctctaggaac

SEQ ID NO: 55167 - DNA, 472 bp, Homo sapiens
caggcagttgggattataaatcttccagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatgggaaattttaaactcaagagc

SEQ ID NO: 55168 - DNA, 470 bp, Homo sapiens
cggaggtgtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattaagttgtacaactagtttagaaggtttcagaataaacatgcatttcata

SEQ ID NO: 55169 - DNA, 187 bp, Homo sapiens
tgttagtggaagcgtctggaatggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcg

SEQ ID NO: 55170 - DNA, 470 bp, Homo sapiens
  misc_feature 20: n = A,T,C or G
tggcaaatcttgttaatgtnattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttg

SEQ ID NO: 55171 - DNA, 473 bp, Homo sapiens
gggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcaagttctgttacgttacccataagggtgaaattcgtggagcaagtacacctttcca

SEQ ID NO: 55172 - DNA, 472 bp, Homo sapiens
gaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatataggagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatga

SEQ ID NO: 55173 - DNA, 423 bp, Homo sapiens
  misc_feature 6: n = A,T,C or G
aaactnatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatatttgaaaatcaaaggagg

SEQ ID NO: 55174 - DNA, 473 bp, Homo sapiens
gaggcattgaggcagccagcgcaggggcttctgctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtg

SEQ ID NO: 55175 - DNA, 473 bp, Homo sapiens
gagggagaatgtcactattaatttatcataccatttccaaaaagggctttgtgcttttcacataaaattgagacagtgtatatttaatctaatttaaattttaaagagatactggtattttgaaaatgcaaccctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagat

SEQ ID NO: 55176 - DNA, 213 bp, Homo sapiens
  misc_feature 212, 213: n = A,T,C or G
agaagaccccacttcaggcactaagaggggctggacctggcggcaggaagccaaagagactgggcctaggccaggagttcccaaatgtgaggggcgagaaacaagacaagctcctcccttgggaattccctgtggatttttaaaacagatattatttttattattattgtgacaaaatgttgataaatggatattaaatagaataagtcctnn

SEQ ID NO: 55177 - DNA, 421 bp, Homo sapiens
gaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggac

SEQ ID NO: 55178 - DNA, 429 bp, Homo sapiens
  misc_feature 23: n = A,T,C or G
gacggttcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggtatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaac

SEQ ID NO: 55179 - DNA, 472 bp, Homo sapiens
ggaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaattatga

SEQ ID NO: 55180 - DNA, 238 bp, Homo sapiens
gagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatg

SEQ ID NO: 55181 - DNA, 246 bp, Homo sapiens
  misc_feature 5, 17, 58: n = A,T,C or G
acccngggaattcggcnttatggccgagtgtgaaacatggttgtaatatgcgactgcnaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactac

SEQ ID NO: 55182 - DNA, 393 bp, Homo sapiens
atgtggctgcaagaaaaagatttaactgcaacttccttgattcctacctaccacacttaatgcttacattattttaaaatagtaagcaattaggtaattcacaagatggaaaaatcaatgcagtcttagtaggtcctcaatgaattgtggctcttgttttcattatttctgctgctcacatggaggtcaatgccctcttgaacagtagcatagaccttatttagaagtctcatttatcaaggtatgaaaacttacaagcagggctgaggtagaaagaaagtgttgttttgatgctgatttcctcttatccaaggaaggagaaagtttgggtcactgatacaattgttctaccgttacagatacctaaaaatcttgtttgctttaatcttcagc

SEQ ID NO: 55183 - DNA, 468 bp, Homo sapiens
atacactgcctggtctacaataaacaatatgaagtcttctttaaaaatatgacaaccttctgctttatatttgctcatctatgggaaggggggcatattttgaccatctcttttgcaataaagctgaattttggttacattccaatatggaaagtgctgatagcattatacaattttcaagaataaagagacatcggatataatttagtgcaactttccaattttaaagatgagtagatttgaggctcagaattgtaacataaattggtggcagaaccgtctctactgtctggtccagtatcttggtaggaataataaagttactccttgtggctgacaaaggagataaaatgtacaaacttttatttagtgaatggttcttgaaaataagtgatatgcaatattggcctctataatccaagtgaatatttgagtcctagaaatatagttgcttatacatcaacaatg

SEQ ID NO: 55184 - DNA, 334 bp, Homo sapiens
ggaggcaggtggtctaagtgctgactggctacgtagttcaggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaagtaaatcttttattct

SEQ ID NO: 55185 - DNA, 354 bp, Homo sapiens
aacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttatta

SEQ ID NO: 55186 - DNA, 464 bp, Homo sapiens
gagagtaaaggcaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 55187 - DNA, 409 bp, Homo sapiens
  misc_feature 396: n = A,T,C or G
ggttgagatgaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagantagagaagatagg

SEQ ID NO: 55188 - DNA, 343 bp, Homo sapiens
ggaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatat

SEQ ID NO: 55189 - DNA, 357 bp, Homo sapiens
gtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaga

SEQ ID NO: 55190 - DNA, 419 bp, Homo sapiens
  misc_feature 14: n = A,T,C or G
aacatatgaaattngttaaaagaatgtgtgcttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagt

SEQ ID NO: 55191 - DNA, 473 bp, Homo sapiens
cgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtggtgagtcttttcagcaacccggtccagtactgggagatacagccatc

SEQ ID NO: 55192 - DNA, 500 bp, Homo sapiens
  misc_feature 5, 11, 45, 72: n = A,T,C or G
taatntatacnattatggcgcgggggggacatggagtattccagngtgcctgtatggagtggaatgaatgtngctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcggatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggatt

SEQ ID NO: 55193 - DNA, 205 bp, Homo sapiens
  misc_feature 4, 179: n = A,T,C or G
attntggtcgggggcaagtgaccgacaaaattccgttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactc

SEQ ID NO: 55194 - DNA, 473 bp, Homo sapiens
aggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggttttta

SEQ ID NO: 55195 - DNA, 123 bp, Homo sapiens
ccttatggcgggcagaggagcaagaagcctgctgcataaactcttaaatttgattattccataaaggtcaaatcattttggacagcttcttttgaataaagacctgattatacaggcagtgag

SEQ ID NO: 55196 - DNA, 123 bp, Homo sapiens
  misc_feature 16, 19: n = A,T,C or G
cggccttatggcgggncancaaaagtcttttaataacaaaagctgcagttctctgtgaaatctcaaatattgttgtaatagtctgtttcaatcttaaaaagaatcaataaaaacaaacaaggg

SEQ ID NO: 55197 - DNA, 471 bp, Homo sapiens
  misc_feature 8: n = A,T,C or G
atctcagnaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttg

SEQ ID NO: 55198 - DNA, 460 bp, Homo sapiens
gaagtgcagcctgtggtgcatacaataatttattctcttgtttagttttttaaaactggatttctggctcatctcttgtaagatgttaaagttcttttcatgcaaatggaagggatcttagggcaactttaagtttgaaaaatataaaatgaatggaaagatttctaccaatttatctgttgcagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgatcgagaagaggattggtaaagaaga

SEQ ID NO: 55199 - DNA, 458 bp, Homo sapiens
  misc_feature 14, 75, 76, 111, 182, 208, 216, 342, 380, 381, 444: n = A,T,C or G
atcttaacaatggnttttaactcctttttgttttctccatagtttaagagacgagcatattttttaaaagacagnngttagcctaaaatctaatactgaaactttgagtgnagccccacattttattttgtacataatttgagagatcaatacatttaaaataattagtagaacggggtatngtggtatatgcctgtaatcccagctnctcagtangctgaggtgggaggattgcttgaacccaggaattcaagaccagcctgggcaacatagcaaagacccatttcttccaccccatgaatgaatgaatgagttattaatttaagtttaagggcaaaagcnaataactaataggggcacagtatataaggatgtggttnngtgacatcagtaaccaaaaggggtagagacagagctgtaaaggagcagattctttgaatagtngtgaagtcaaactg

SEQ ID NO: 55200 - DNA, 500 bp, Homo sapiens
  misc_feature 2, 7, 336, 388: n = A,T,C or G
cnggganttcggcccttatggcccggggaggtgaaattaaatgagatgatgaaattaaatgatgaaatgaaataatgaaatggaaatgaaatggaaatgatgagatgaatgatgagatgaaatgatgagatgagatgtaatgatgagaggaaatgatgagatgtaatgaaatgagatgaaactgaatgagatgaaatgaaataatgaaaggaaattgaatggagatatgagatgaaatgagataaaatgagatgaaataaatgatgagatgaaatgatgaaatgctgaggtgagatgagatgaaatgagatgaaacgatgagatgaaatgaaagantgagatgaaatgatgagatgaaatgatgaaatgagatgagatgagaagaaantgaccttgatgagatgggataaaatgatgaaatgaaatgaagtgaaatgaaattgaaatgagatgagatgaaatgagataaaatgatgagatgaaatgagaagaaatgagat

SEQ ID NO: 55201 - DNA, 288 bp, Homo sapiens; identical to SEQ ID NO: 24046

SEQ ID NO: 55202 - DNA, 367 bp, Homo sapiens
gttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgtcaaagctttactactgtggaaagacaactgttttaataaaagatttacattcc

SEQ ID NO: 55203 - DNA, 203 bp, Homo sapiens
  misc_feature 4, 17, 31, 60, 62, 77, 84, 104, 106, 165: n = A,T,C or G
gggnaaattttccgggncccatcttatgggncccggggggggggaaggggccattttggnangggccagcccccagnccgccanggggggcctttccttgcctngnaggggggggccagggccggggagccctttgggaggggaaaaccccgccaggattaaagnttttttttttttccttcctttttgggaaaaggattagg

SEQ ID NO: 55204 - DNA, 428 bp, Homo sapiens
gctttttttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaggaggctccgggttgacaaatggtggggtaacagaaaggaactggctaccgttcggactatttgtagtcatgtacagaacatggtcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttg

SEQ ID NO: 55205 - DNA, 440 bp, Homo sapiens
ggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatg

SEQ ID NO: 55206 - DNA, 108 bp, Homo sapiens
atttggagaagatagaagtttgaagtggaaaactggaagacagaagtacgggaaggcgaagaaaagaatagagaagatagggaaattagaagataaaaacatactttt

SEQ ID NO: 55207 - DNA, 474 bp, Homo sapiens
aacatagaaataaagagaggcctgtccagtctttgaaaacatcaagagatacttcccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtg

SEQ ID NO: 55208 - DNA, 215 bp, Homo sapiens
cataggactctggacaatctcacaccttagctattcccagggaaccccagggggcaactgacattgctccaagatgttctcctgatgtagcttgagatataaaggaagggccctgcacaggtggctgtttcttgtctgttatgtcagaggaacagtcctgttcagaaaggggctcttctgagcagaaatggctaataaactttgtgctgatctgg

SEQ ID NO: 55209 - DNA, 166 bp, Homo sapiens
  misc_feature 25: n = A,T,C or G
atattaggtgtggctgagtataatnagttaaccagaatattaccttttgaaacctttgtttcaagcaataacttaaagcagtatttttgtgtagttattactcttatttgagtttggctatcataaccaaaacaattaggtgtactctgagtataatttgtatttt

SEQ ID NO: 55210 - DNA, 169 bp, Homo sapiens
cgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgttta

SEQ ID NO: 55211 - DNA, 354 bp, Homo sapiens
  misc_feature 27: n = A,T,C or G
gttaaaaatacaaatctaaagcccagngtaaaagagagagttaaagagatttgggagttgttaccccacatagatggtaagtgaaaccatgtgaatggatataatcattataggtaggaaagattgttttctgcttcacaatcgctgtgtctaatatgcatgtgcataaaatcgtaattctttcctaccgttttacaacttatacaataggttgttagcatactgttataaatattaaaaaaatttatttgaaaatgactgccttatctgttacagagaaacttttttgaaaatttgatgttagacagtattttctatcagtttcctgaaattgtccattctacatgatgaaga

SEQ ID NO: 55212 - DNA, 234 bp, Homo sapiens
ggaggccagggctgctggatcacgaggtcaggcgttccagaccagcctggccaacatggcgaaaccccatctctgctcaaaatacaaaaattagctgggtgtgctggtgcacacctgtaatcccagctactcaggaggctgaggcaggataattgcttgaacacgagaggttacagtgagccgagattgtgcaactgcagtccagcctgggtgacagagaaatactgtctcaga

SEQ ID NO: 55213 - DNA, 471 bp, Homo sapiens
ggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctg

SEQ ID NO: 55214 - DNA, 470 bp, Homo sapiens
ggggaaaaaattgtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcggaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataaagagtgtattaccattaaagtcattagtataatattgctttcaaaaagaaatggtagacaaaactataatccagcatcttttattgcattggaaagactggcaaagtcttttggatgggttgggaagatgtggctggaaagtactttggaaaata

SEQ ID NO: 55215 - DNA, 335 bp, Homo sapiens
  misc_feature 9: n = A,T,C or G
atcaccagnaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctg

SEQ ID NO: 55216 - DNA, 315 bp, Homo sapiens
aacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatc

SEQ ID NO: 55217 - DNA, 473 bp, Homo sapiens
gggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctagaacatgacggaggttgagatgaagcttcttcatggagtaaaaaatgtatttaaaagaaaattgagagaaaggactacagagccccgaattaataccaatagaagggcaatgcttttagattaaaatgaaggtgaccttaaacagcttaaagtttagtttaaaagttgtaggtgattaaaataatttgaaggcgatcttttaaaaagagattaaaccgaaggtgattaaaagaccttgaaatccatgacgcagggagaattgcgtca

SEQ ID NO: 55218 - DNA, 470 bp, Homo sapiens
ggcctatttccggtaggaatcagtggacttggcggcagaggcagtgcggatccggcgttctccactgatcttttccaaggctgtacagacatggcggcggcttttcggaaggcggctaagtcccggcagcgggaacacagagagcgaagccagtgactaccgtaaaaaacaagaatacctcaaagctcttcggaagaaggctcttgaaaaaaatccagatgaattctactacaaaatgactcgggttaaactccaggatggagtacatattattaaaggagactaagggaagaagtaaccccagaacaactaaagctgatgagaactcaggacgtcaaatatatagaaatgaaagagggttgcagaagctaagaaaatcgaaagactaaaatcagagctccatctgctggatttccaggggaagcaacagaacaagcatgtgttcttttttgacaccaaaaaggaagttg

SEQ ID NO: 55219 - DNA, 471 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattaccgaaatacataggcttata

SEQ ID NO: 55220 - DNA, 414 bp, Homo sapiens
cttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttat

SEQ ID NO: 55221 - DNA, 473 bp, Homo sapiens
gggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagagggaggatgaggcaccattccaggagaaagattccggcagcgatgaagatttcctaatggaagatga

SEQ ID NO: 55222 - DNA, 474 bp, Homo sapiens
  misc_feature 10: n = A,T,C or G
gaactcaagnagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaagcacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagt

SEQ ID NO: 55223 - DNA, 350 bp, Homo sapiens
  misc_feature 10, 14, 255, 296, 312, 319, 333: n = A,T,C or G
tagaatcttnactngagagtgctgctgatgagtcgatagtactcattttgggctgggtgggggaggagagtgaaatgtctaggagaagtgggatgtgtcaaagccaggaagagagcctcctgctgtattcagcattaactacatactacgtgaaaaatctaatacgggtttggtccccctaattttaaaaaagaatgtgaaaaaatcagtaactgctacctggagtgtgaagggaagtctggtggacagggtganggaattatttatcatcctgcccttttgaagtaagccccatnttaatgtcatgttttnccttttnaaaattttaaatgngaaatccctggagattt

SEQ ID NO: 55224 - DNA, 474 bp, Homo sapiens
  misc_feature 9: n = A,T,C or G
atagccganaaaacaaggatggagaaaaatctaggacagtgtcttctgagaaaccatcaggcttgaaggctacaagtgccgagaaagattctgttttgaatatagccagaggaaaaaagtatggagaaaaaactaagagagtgtcttctcggaaaaaaccagccttgaagtgtcttctcagaaacaaccagcattgaaggctatctgtgacaaggaagattctgttccgaatacggccacggaaaaaaaggatgaacaaatatctgggacagtgtcttctcagaaacaaccagccttgaaggctacaagtgacaagaaagattctgtttcgaatatacccacagaaataaaggatggacaacaatctggaacagtgttttctcagaaacaaccggcctggaaggctacaagtgtcaagaaagattctgtttcgaatatagccacagaaataaaggatggacaaatacgtgggga

SEQ ID NO: 55225 - DNA, 266 bp, Homo sapiens
  misc_feature 151: n = A,T,C or G
caatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcangagcattgtgcaatacagtttcattaactccttccctcgctcccccaaaaatttgaatttttttttcaacactcttacacctgttatggaaaatgtcaacctttgtaagaaaacc

SEQ ID NO: 55226 - DNA, 470 bp, Homo sapiens
  misc_feature 40: n = A,T,C or G
gtaagagacaccgtggatattcttctcagaagctttaatnaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtgccattttttattgttgtgccagtgaatccagttgccagaaataagtctgaatgttttcatgcatctttttcttaaatgcaagagcttctactgactcttaacaagcatgctta

SEQ ID NO: 55227 - DNA, 473 bp, Homo sapiens
atatgaatgttaaaaacgtagaagagtagggaatctttagggaaaggagagtaatggagggcctgggatgtggttttgtacactaatacactaaaaagagtatttcttagggtggagagatgaaaactgttaggaaatactattatgggccaagaattttgatgggaatggagcatgtgaatgtcactctgatcacttttatgtaaaaattataatttaattaataaaaaatttcttaagaagtaaaatgaaaccttagtcatctttatgatcccatcggcctgtcctgtgtcttgtttgggtacatggataatatttagttaattatcaatactgtttcatattttatatgaaaaaaaatatgatacatcttttatagccaatttactgaaagtagcttaatttgaggtagaatatgatcatgatatgttgccagatattcaatgctgcatcatacattccattcggaagtc

SEQ ID NO: 55228 - DNA, 472 bp, Homo sapiens; identical to SEQ ID NO: 26019

SEQ ID NO: 55229 - DNA, 474 bp, Homo sapiens
  misc_feature 355, 450: n = A,T,C or G
gtaatatggtaaaaatgtgagctagcacttctgcgttccttttgattttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatganacttcctaggaagggatgcactgtaaaacaaaagtattcttgtaactcagttttgtgaaaggtaaaaaactactatgtttttaagtacactttanaaagtctcttcaaaacaaacagtc

SEQ ID NO: 55230 - DNA, 325 bp, Homo sapiens
tacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 55231 - DNA, 474 bp, Homo sapiens
  misc_feature 461: n = A,T,C or G
gtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacgggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatgggttttgggactagaggctcagtggtggggagagatccctgcagaacccaccaaccagaacgtggtttgcctgaggctgtaactganagaaagattctgg

SEQ ID NO: 55232 - DNA, 474 bp, Homo sapiens
  misc_feature 10: n = A,T,C or G
caataagatngcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtattgaatgtctacgtgttgctaacgaagtcactcttaattaatatctgtatcctggaacaatatttatggggtatggttttcctgggggggcaggtttcatagtatccatattttattactggttattacttccatgaat

SEQ ID NO: 55233 - DNA, 473 bp, Homo sapiens
  misc_feature 437, 443: n = A,T,C or G
ctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtaagttgtgatacaacacatgtggcttttatttgtactgcacatatccactgtacagccacttgggagnttcggnggttagcttgcagcaactgctgtctgcatt

SEQ ID NO: 55234 - DNA, 474 bp, Homo sapiens
ataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttg

SEQ ID NO: 55235 - DNA, 473 bp, Homo sapiens
attgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggggttggttgatctttttttttccttacagacacccataataaaatatcatatt

SEQ ID NO: 55236 - DNA, 474 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatg

SEQ ID NO: 55237 - DNA, 472 bp, Homo sapiens
  misc_feature 7, 29: n = A,T,C or G
ctctgtnagtcgcgagcgaacgaccaagnaggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattgggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgt

SEQ ID NO: 55238 - DNA, 474 bp, Homo sapiens
  misc_feature 27: n = A,T,C or G
ataaaatgtattattaaaatgaatttnacctctttctatccttttcagtgtgctactagaaaatgtaaaattacatctgtggcttgcattgtacatatattttgttggatgttgctgtcttgtatggcaatgaaatgtaatgttcgagattattctttctacagggcagaaattcattatatttctagatacagtgtatttgcatttcaatggataataattatttgctttactaacagttttctatagcttaacttctacccttacagagttacaaaatagcctaaataataggaagacaatcagtcaaaggtacatacctggatagagccagacaatcctgggatggtcatttggataatatgcaagcacttcactgaaaggacactcagtaatcttttgcccattgccaagtctttggcaatttttcctaaaagcatctttccatattcttttgttactgtcccatggaat

SEQ ID NO: 55239 - DNA, 160 bp, Homo sapiens
cagtttgatttgggaatcttcccctttccaatgaaatagagatgcagtacttaactttccttggtgtttgtagatattgccttgtgtattccacttaaaaccgtaatctagtttgtaaaagagatggtgacgcatgtaaataaagcatcagtgacactct

SEQ ID NO: 55240 - DNA, 472 bp, Homo sapiens
gaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttg

SEQ ID NO: 55241 - DNA, 213 bp, Homo sapiens
cattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaag

SEQ ID NO: 55242 - DNA, 289 bp, Homo sapiens
caacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagc

SEQ ID NO: 55243 - DNA, 474 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgaaagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtga

SEQ ID NO: 55244 - DNA, 201 bp, Homo sapiens
gccttttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagtttt

SEQ ID NO: 55245 - DNA, 459 bp, Homo sapiens
  misc_feature 21: n = A,T,C or G
gatatgtgctaaaaataaagnattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttaaatacagtttttatttcatgaaga

SEQ ID NO: 55246 - DNA, 365 bp, Homo sapiens
ctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggttta

SEQ ID NO: 55247 - DNA, 285 bp, Homo sapiens
  misc_feature 284, 285: n = A,T,C or G
aaggtataaaaacaaagaggaataattccttgaaccttgattctggaaactttgatccacccagcagtcatgatgttagactcattgaaaagaatgtatttctaatgcatgatgcgatcggtctatagatgtgtcatggaaacttggttgcaaccttcaagacaaaataaaaagtaaacatttacatgaaaaatggtggatatggaaggtggagaagagaggagataacagctttatctttcaaaatagagaattgagagatggtaccaaaagctgatgaagcnn

SEQ ID NO: 55248 - DNA, 474 bp, Homo sapiens
aaatgaagaattgtggaaactatacagacacatggaaattaaacagtgtactcctgagtgatcagttggtcaatgaagaaattatgaaggaaattttaaaagttttttgaaataaatgataatggaaacagaacatatcaaaactaagagggaaatttgtagtgacaagtgcctacatcaagaaagtagaaaaactttcaataaaaaaaccaacaatgcatcttagagaactagagaagcaagagtaaaccaaacccaaaatcggtagaattaaataaataataaagatcagtgcagaaataaatgcagttgaaatgaagaaaataatacaaaagatcagtgaaatgaaaagttggttttttgaaaagataaacaaaattgacagacattttgaaaagataaacaaaattgacagaaaaaaagatagaagacccaaataaataaaatcaaaattgaaaaaggttaccttacaat

SEQ ID NO: 55249 - DNA, 134 bp, Homo sapiens
ataacaaaagggacagaagcattcctgctcttgtgaagtttacattgactagatagtaaacaaaataaatgaagtatgcagtgtgtcagtgctggtaaacccgtggagaaaataaagcaaggttggggtctggg

SEQ ID NO: 55250 - DNA, 274 bp, Homo sapiens
gagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagag

SEQ ID NO: 55251 - DNA, 330 bp, Homo sapiens
  misc_feature 44: n = A,T,C or G
gatgtgtgtaagggaagattttatttgcccttccggaagaaatnagtatctatgcaaatcttgaaagacgaaatcaaagcccattaatgattcagaatcagtgcttgacctcctgtattctgaatggtgaactctggaagcagggattgtgtctggctctttttagagctggaagtgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattg

SEQ ID NO: 55252 - DNA, 100 bp, Homo sapiens
gaggcaggcgaatctcttgaacccgggaggcggaggttgcagtgagccgagatcacaccattgcactccagcctgggcaacaggagtgaaattccatctc

SEQ ID NO: 55253 - DNA, 106 bp, Homo sapiens
aataaagggtacatgttgtacaggcctttattatacaaacctctacaataaaacaatgaataacacatcactgccaagacagttatacagtgttaaattggaatgg

SEQ ID NO: 55254 - DNA, 497 bp, Homo sapiens
  misc_feature 9, 17: n = A,T,C or G
aattcggcnttatggcnggatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttgttgtggtt

SEQ ID NO: 55255 - DNA, 328 bp, Homo sapiens
  misc_feature 276, 296: n = A,T,C or G
ggcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgnttgcccagagctggagcctnagcttgaagatgatgctcaaggtactcttgat

SEQ ID NO: 55256 - DNA, 455 bp, Homo sapiens
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtgggg

SEQ ID NO: 55257 - DNA, 182 bp, Homo sapiens
gggctggtgagatggctcagtgggtaagagcacccgactgctcttccgaaggtccagagttcaaatcccagcaaccacattgtggctcacaaccatccgtaatgagatctgactccctcttctggagtgtctgaagacagctataatgtacttccatataataaataaataaataaatcttt

SEQ ID NO: 55258 - DNA, 343 bp, Homo sapiens
  misc_feature 258, 342: n = A,T,C or G
gagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgncacaaccttccggaaggagtagctgacctgacacagattgatgtcaatgtccaggatcatttctgggatgggaaaggatgtgana

SEQ ID NO: 55259 - DNA, 305 bp, Homo sapiens
gacgtaaagcattaatgcagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaacttt

SEQ ID NO: 55260 - DNA, 469 bp, Homo sapiens
gtttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaagg

SEQ ID NO: 55261 - DNA, 476 bp, Homo sapiens
atctgaagaggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatgggagcttgtaaaaattatttacaagaatactcctgagaatttacatgaaatggctaaacataatctcttacttcatttgaaaaaactagaaaaagaaggaaaaatatttagcaacacagatcctgaca

SEQ ID NO: 55262 - DNA, 474 bp, Homo sapiens
ggtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcg

SEQ ID NO: 55263 - DNA, 200 bp, Homo sapiens
  misc_feature 199, 200: n = A,T,C or G
gatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcctgcnn

SEQ ID NO: 55264 - DNA, 447 bp, Homo sapiens
ggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgaagtttgtg

SEQ ID NO: 55265 - DNA, 473 bp, Homo sapiens
aggagtccctgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactaggagatggacaggttatcaacgaaacttctcagcatcacgatgaccttgaataaaaattgcacaca

SEQ ID NO: 55266 - DNA, 283 bp, Homo sapiens
  misc_feature 3, 283: n = A,T,C or G
acnctctttaaatcttaaagggatttttctcataggtattctacttaagtacagacaaataatttaatcctcccatagtgtatccaccatatttgtggcttgtaaatgttttaaaacttgggcataagtagctgataagttacaaaaaagatacaaatttcaataaggtaattttagttaaagtgacaggaaatgggggtgcattttgaatagaaaaacacagaactccaaaaacaagacaaaaaaccatgttatttccaaagagaacatctcagttgtgccn

SEQ ID NO: 55267 - DNA, 366 bp, Homo sapiens
atgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacct

SEQ ID NO: 55268 - DNA, 185 bp, Homo sapiens
  misc_feature 2, 100, 143, 170, 174, 179: n = A,T,C or G
cnaacatcctgaaataccacattggtgatgaaatcctggttagcggaggcatcggggccctggtgcggctaaagtctctccaaggtgacaagctggaagncagcttgaaaaacaatgtggtgagtgtcaacaaggagcctgtngccgagcctgacatcatggccacaacntggngtggnccactg

SEQ ID NO: 55269 - DNA, 392 bp, Homo sapiens
ggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttatttgtattttt

SEQ ID NO: 55270 - DNA, 474 bp, Homo sapiens
aggtggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagttt

SEQ ID NO: 55271 - DNA, 477 bp, Homo sapiens
ggttaagcgaataagcgtacacggtggatgcctaggcaatcagaggcgatgaaggacgtgctaatctgcgaaaagcgtcggtaaggtgatatgaaccgttatacccgacgatatccgaatggggaaacccagtatccaatggatactatcattaactgaatccataggttaatgaggcgaaccgggagaactgaaacatctcagtaccccgaggaaaagaaatcaaccgagattcccctagtggcggcgagcgaacggggagcagcccagagtcttaatcaatagcagtgtcaggagaacggtctggaaagtccggcagtaaagggtgatagccccgtatctgaagatgctgttattgtgaactcgatgagtaggggcgggacacgtgttatcctgtctgaatatgggggggaccatcctccaaggctaaatactcctgattgaccgatagtgaaccagtaccgtgagggaaaggcg

SEQ ID NO: 55272 - DNA, 374 bp, Homo sapiens
  misc_feature 2, 7: n = A,T,C or G
tntggcncggggtaccccctgaagtagttcagtcctgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttg

SEQ ID NO: 55273 - DNA, 464 bp, Homo sapiens
  misc_feature 393, 442: n = A,T,C or G
ggatcgcttgagcccaggaggcggaggttgcagtgagctgagatggcaccacttattgcactccagcccgacagagcgagactccatctaccagatccttatgacgcagctgatgcctgccttggttcctaccactctggtgtagacagaggactttgtccaagtctcacactaaacatgcccgggcttcgatgtgccttggaggatttccccacagggacccacgcacctccctgtatctgcgcagcttgctcgtgtggcttggaagcgctgtcgataagcttcacgcactggcttgccagttcttcagctctaggacttgtagcttttaagcaaacggtgtggatggggttggagtgtggccacctgcaggatgtgcaggggctgcctcanaagctggctggggactctagcctctgtgttcataaagacattaagaagnggatgggatggttgttcctttt

SEQ ID NO: 55274 - DNA, 249 bp, Homo sapiens
gagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcgctgcagtgagggtcaaaggagagtcaacatatgtgattgttccataataaacttctggtgtgatactata

SEQ ID NO: 55275 - DNA, 319 bp, Homo sapiens
caagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcggatgatgacatgggatttggcctttttgattaaattcctgctcccctgcaaataaagcctttttacacatct

SEQ ID NO: 55276 - DNA, 405 bp, Homo sapiens
  misc_feature 14: n = A,T,C or G
gaggaaaccgcagnataagttttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcgtggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaaga

SEQ ID NO: 55277 - DNA, 214 bp, Homo sapiens
tatggccgggattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgc

SEQ ID NO: 55278 - DNA, 473 bp, Homo sapiens
  misc_feature 219, 221, 300: n = A,T,C or G
ccgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgngngggatataaattagtttttattattctcttaaaaatcaaagatgatctctatcactttgccacctgtttgatgtgcagnggaaactggttaagccagttgttcatacttcgtttacaaatataaagatagctgtttaggatattttgttacatttttgtaaatttttgaaatgctagtatgtgttttcaccagcaagtatttgttgcaaacttaatgtcattttccttaagatggttacagctatgtaacct

SEQ ID NO: 55279 - DNA, 471 bp, Homo sapiens
  misc_feature 23: n = A,T,C or G
caagtgggtccagtaaatgagantgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggga

SEQ ID NO: 55280 - DNA, 465 bp, Homo sapiens
  misc_feature 4, 9, 417: n = A,T,C or G
gacnttgantaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatggtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggcttggatggggtanttaaactcttcaggcataattgatgcaactagagtcaatatgctgatt

SEQ ID NO: 55281 - DNA, 132 bp, Homo sapiens
ccccccactaacttattttgcccggctgaggttgtggggggcgcctcctggggtgcacgattccctcagctctgggtttaatgtattatatttatttggggccgacagtgccccaataaagggtcagaagtg

SEQ ID NO: 55282 - DNA, 413 bp, Homo sapiens
caggtctcataaggtattgtaagcaaagatgattcagaagaaaaccaattaaaatcctgtaaatttgaattaaattaatcctgctttgtctctatacggtgatttgtaacttgtcttttcctagtttaaaaaaatatatatcatggattggccgtgtgcagtggctcatgcctctaattccagcattttgggaggccaaagtgggtgtattgtttgagcccaggagttcaagaccagtctgggcaacatggtgaaaccccatctctataaaaaaacatacaaaaataagtcagctgtcatggtacatgcctgtagtcccagctactcaggaggctgaggtgggaggatggattgagccccggtgatcacaccactgcactccagtttgggtgacagaatgagacctcttctcc

SEQ ID NO: 55283 - DNA, 374 bp, Homo sapiens
  misc_feature 23: n = A,T,C or G
ggaagcatgcagtatcaaaattngatgaagccagtatgcattcaagatgatagtaataagggttaagtcatgtgaaagaaaatcggcttgacaacagtaggctaaatatgacagaagatggtgcttttaaaaaaaatgatgtttatacaaataagagatttttatttcccctcaggggaaataaactctaattttcctgagcagtgaagaccagaaaagaatgacgacttttctgctcaaatatctgtttaaacaaccttgatagacatttgggcatctcaaaattgaaatgaaactttctttggcaataacattgactaatcaatcagcagagggttaggttccttaaaatggagctagctttttggattatt

SEQ ID NO: 55284 - DNA, 135 bp, Homo sapiens
  misc_feature 10, 19: n = A,T,C or G
atataagagngggtgaaanccgtagccctttgcattctctatagcctctgcagagagatactaagcagcaaaatcttggtgttgtgatgtacagaaatggagaagagtattaaaccatatttaagaataaaaaga

SEQ ID NO: 55285 - DNA, 401 bp, Homo sapiens
ggacccattactgtttctgcaccttttcacttcagtaaatgaattcctaggggtttccagtatagcaagctttactcccaacccagttcgtatatgatgtgtactgagacaggagatcgaaaggcaatgccaagatccccacctcccgccctacactgtcctcttccctattaatgtggcagtaaaagaacacagggctatcattttttggagcacctgccatatttcagattgtgtgccaggtgatttacaaaccttgtctttaaatctcaggacattcttacgagatgggtatgatcctcattccctagatgagggaactgaagctcagagaagggttatgtcctttgcctgagatgacacacctctactaagggagataaaaccagcattcagaccct

SEQ ID NO: 55286 - DNA, 469 bp, Homo sapiens
tggataaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttg

SEQ ID NO: 55287 - DNA, 471 bp, Homo sapiens
accttcagatgtgtctacgtgcgctctgccactcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagggatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaat

SEQ ID NO: 55288 - DNA, 473 bp, Homo sapiens
  misc_feature 58, 100, 107, 130, 141, 251, 338, 415, 453, 456: n = A,T,C or G
atttgtaagaattggagcaatgttggcctatacgccccttgatgagaaaagccttgcnttattgttgggctatttgcgtgatttcctaaaatatctgggnaagaatnctgcatctctctttactgccagngattacaaagnggcttctgctgagtaccaccgcaaagccctgtgagcgtctacagacagctcaccatttttgtcctgtatctgtaaacactaattgttcttagtctttttcttgtaaaatngatgttctttaaaatcgataatgtataacagggcttatgtttcagtttgttttccgttctgttttaaacagaaaataaaaggagtgnaagctccttttctcatttcaaagttgctaccagtgtatgcagtaattaggaacaaagaagaaacattcagcagaacnttttattgcctagttgacaacattgctagaatgctggnggntcctatccctttgacac

SEQ ID NO: 55289 - DNA, 400 bp, Homo sapiens
gagctaatataccaaaacatcttaacatctaacctagtcagagctaataaaccataagacaaaatttacacataactgtatgtgtgcctcatagaatgattttttaaaaaattactcataatagctagattttacttcagttaacatgaattaaattgtagtgccttagtaaagcttcacttcttcaaggtctgtatataatttttggccatcagaattattttaaattactgtatttttcatactctacttttgtgggcttccacctgcattttatcaataggtttcaaagtctgtgaaattacaaattggagctgcacaattttctgaactttctgcttaaaataatcctcagccactacccatacccagtttctctcatacacacacacacacacac

SEQ ID NO: 55290 - DNA, 425 bp, Homo sapiens
  misc_feature 75, 385: n = A,T,C or G
ggagcaagaagaaagtggagtgaaatattacaagtgttaaaggaaaaaacccaccagcctagaattctgtatacntcaaaattattcttccaaagtgaaaaaaaaataaagactttctcaaacaaacaaaaattttgggaattgtcaccaataaacctgctttgcaagaaatgttaaaagaagttctacatagaggaagaaaatggtatatctcagatacttggatctacataaagaaaggaaaagtgttggagaaggaataaatgaaggtaaaataaaatagttttcttattaactgacctaacagataatattttttcaaaataacaatgtatttagtgaatgtagcttaggaataagtgaaattaatgagagtaatattgtntaggatgggagggaataattgggaatactctgttacaagg

SEQ ID NO: 55291 - DNA, 457 bp, Homo sapiens
gtgtcagcatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactac

SEQ ID NO: 55292 - DNA, 474 bp, Homo sapiens
  misc_feature 370: n = A,T,C or G
gtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggagaaaaaaaataacaagaacaaaacacaggagaatgtattaaaagtacttttgttttgttttgtttttgccaattaacagtatgtgccttgggggaggagggaaagattagctttgaacattcctggcgcatgctccattgtcttactattttaaaacattttaataattttttgaaaattaattaaagatgggnaataagtgcaaaagaggattcttacaaattcattaatgtacttaaactatttcaaatgcataccacaaatgcaataatacaataccccttccaagtgccttttt

SEQ ID NO: 55293 - DNA, 486 bp, Homo sapiens
  misc_feature 7: n = A,T,C or G
aatatanaacagataattttaatggccctataattattaaggagatgaatttgtaatttaaaatctctgaactaatctccaggcccagtttcactggagaattcttaccagaattaacaccagttgtacacagactcttccagaaaatagaagaggaaggaacatttcactcattttatgtggttattaacctgctaccaaaaccagataaagacagtattaacaaaaaagataggctgggcacggtggcttatgcctgtaatctcagcactttgggaggccaaggcgggtgggtcacctgaggtcaggagttggagaccagcctggccaacatggtgaaacaccatctctactaaaaatacaaaaattagccaagcctggtggcgggccgcctgtaatctcagcctactcgggaggctgaggcaggagaattgctgtaaccttgggaggcagaaggttgcagtgagctgagatcgtgccattgca

SEQ ID NO: 55294 - DNA, 189 bp, Homo sapiens
acagtgaaagtactgaactttctcctgaactctttgagagtccaaatatccagttctttgtgttaataatacaaccttagtgtcctgtatccagatcagatcagaagagaatatgcctggaggaggtttatctgctggccttgcatcagccaattcaaatgtcagaatcatagtacgtgatctctctgg

SEQ ID NO: 55295 - DNA, 446 bp, Homo sapiens
ggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctcctttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttggaagggagtgtac

SEQ ID NO: 55296 - DNA, 383 bp, Homo sapiens
ggcgcaatagatatagtaccgcaagggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 55297 - DNA, 414 bp, Homo sapiens
atcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatac

SEQ ID NO: 55298 - DNA, 210 bp, Homo sapiens
tattcttttgtagcaaacattcttatgttccttctgtttgccagacactttactcaaacacagctttactgaaacacagctccaccctccagtgggggagatggatacctagcaaaaaataaggggtgctaaatacttaattttatgtgtataaacacacacacacacacacacacacacacacaaaagaaaaaaaaagtattgatttag

SEQ ID NO: 55299 - DNA, 416 bp, Homo sapiens
gtgcaaatccactgaatatgttacttagttccagtagtattttggttgactctttgtgattttctgcacagaagatcatgtcgtctacaaacaaatataattttacttctttctttctgatttcgatgagtttgatttcttctgctatttaattgctctagctaggtcagccagtattgattgaatagaaggggtgagagcactcttgcatcatgtgagatcctccaggaaaggcattccattttccctacttgattattcactcattggtcatttcatggatggtctttctattgtttaggtaaatttcctttctatctattttgtttaggatttctatgatgactggattttgaattttgtgaaatgctttttctccctctattaagatgatgtggttttcatctttcattctg

SEQ ID NO: 55300 - DNA, 157 bp, Homo sapiens
accccaaggctacgtaaggccaccgctaagatatatcttcggtttattctttttcttatgagtactagagttaaataaaacactatctaaatactcggggcaatggtgttaacattattcttgttgaaactagttaccagaataaagaaaaaatatc

SEQ ID NO: 55301 - DNA, 260 bp, Homo sapiens
ggctttcaagcagaaacaaaaagagagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgc

SEQ ID NO: 55302 - DNA, 474 bp, Homo sapiens
atataaggaatatgtacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaaggaggtgcttttttaaaatcgttcatagacttctgtaaaatgcaagataaattaaagttattataacaggtgatt

SEQ ID NO: 55303 - DNA, 401 bp, Homo sapiens
cacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttattttat

SEQ ID NO: 55304 - DNA, 310 bp, Homo sapiens
gaccactaaaaacgtagtgcttgcaaattggggaaaactaaaaagtgaaatgggtaccgctccagagttctatttttgcctaagactgaacttcgtcctcagctgggcttcccgcgaacctggacatcaatgaatcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacga

SEQ ID NO: 55305 - DNA, 472 bp, Homo sapiens
  misc_feature 462: n = A,T,C or G
ggactttagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggacccttttttttttatcatctctggctctctatcaatcgccacagagaaaaggttaaccaagcttttggngcatagcagc

SEQ ID NO: 55306 - DNA, 473 bp, Homo sapiens
atagaattccctaaaatatttctgtttactaacctatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaatttactgggatagctttctattacaggtattgttagattatattgtgctgataagattactttctaaaaaatttgtacttttctgtaaattaaaagaatatggagtcataaaatggcaagtgttttaggattagcctaaaattgaacattgtcattgatttcaaagaaggtatgaactagcagtcttacagcctaattcttctttggactggtccttggcagcagttccttttcagactc

SEQ ID NO: 55307 - DNA, 472 bp, Homo sapiens
atactcagaagtccaaagttcattcttctttaaagtagcctctataactctgtttattttataaatagtattccttatgactgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgataggtttttaactctatggtcattgtatcactctggaaaatgtggagtagctgtaataaatctactcctg

SEQ ID NO: 55308 - DNA, 461 bp, Homo sapiens
  misc_feature 13, 27, 54: n = A,T,C or G
cagtatttttttnttaacatagtaatnatacttagcatttatatactacttttnatttagaagtgccttatgttacttttttaatcctcatactacattactacataaacatattgaatgactgaaaaattaatactaaatcaaatgtatgaggtataatgttcaaagtgtattccctaattaataccagggactacatgcatacatagttatatgtaaattagatactttggatttattttttcaccaaggaaccaaaacacaatacagaatagtattgtaaatagattaagatgattgggttgaaaatgtagatactgattttaggttgaccttaaaaaatatatatattcttattaaattatagcttttggagaatataaactttcctgtgttcccaacaaaatggatagttttgctgccaggttaccctccctttgtttatcatgagtctttagagg

SEQ ID NO: 55309 - DNA, 162 bp, Homo sapiens
gtctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaat

SEQ ID NO: 55310 - DNA, 415 bp, Homo sapiens
catgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctggtggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaatt

SEQ ID NO: 55311 - DNA, 147 bp, Homo sapiens
gattctttacctttacttcatcttgcccttcattattgcagccctagcagcactccacctcctattcttgcacgaaacgggatcaaacaaccccctaggaatcacctcccattccgataaaatcaccttccacccttactacacaag

SEQ ID NO: 55312 - DNA, 256 bp, Homo sapiens
atctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctc

SEQ ID NO: 55313 - DNA, 174 bp, Homo sapiens
gaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatag

SEQ ID NO: 55314 - DNA, 473 bp, Homo sapiens
gtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatgggatgttactctcttgcaccaaattatcttgatacattcaaatttgtctggttaaaaaatagggtggtagatatttga

SEQ ID NO: 55315 - DNA, 472 bp, Homo sapiens
ggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaagggatgtttttctttatttttgttaatattaaaagtctgtatggcatgacaactactttaaggggaagataagatttctgtctactaagtgatgctgtgataccttaggcactaaagcagagctagtaatgctttttgagtttcatg

SEQ ID NO: 55316 - DNA, 272 bp, Homo sapiens
gaatgacatgaatccagcaaataggatccaacacaggcaatattccagctatggaactagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagc

SEQ ID NO: 55317 - DNA, 362 bp, Homo sapiens
  misc_feature 15: n = A,T,C or G
gatctgtttaacatnggaaggagtttaggaagaattttgccacctctctttattcctgattaagggagatacatctggggactataagaaagctcttctgctgctctgcggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgctcctttctgatctctagtggagatctctttgactgctgtagtactaaagtgtactttaatgttactaagttttaatg

SEQ ID NO: 55318 - DNA, 474 bp, Homo sapiens
ggaggtatgtgggtgagacgcagccaacaggacaaataaagattaaaagggaggactatgaatctcttccaaaagaggttgccagtgctaaacccaaagtattgctagacgtgaaactgaaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaaggaatggaacgacagtacttcagtccaaaatccaactcgcctccga

SEQ ID NO: 55319 - DNA, 474 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtga

SEQ ID NO: 55320 - DNA, 411 bp, Homo sapiens
gggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaatttgtggatttaattgtgaaatgttctttcacttgtaagtttcagtcattttcttttacctcgttgtcagtgtacagaatg

SEQ ID NO: 55321 - DNA, 458 bp, Homo sapiens
ggacttagtacttacgacttcttaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttggggtttacccgtatttccaacacacgatagtaaggagcatttagcaatgatggaaagggatttcttgg

SEQ ID NO: 55322 - DNA, 500 bp, Homo sapiens
  misc_feature 2, 5, 175: n = A,T,C or G
anccngggaattcggccttatggccgagggtgcaaaacggggtggcactccaatcgcctgcttggtgattgtggcccccacacacctgtttctacagcgcttagcttcatcgcagtaggaatggcagccccatctatgaaggaaagacaggtctgctggggggcccgggatgagncctggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcccaggctgttcataaagattgaaagtattctttctggacattgaaaaagctccactgactatggaacagtaatagtttgaatcatagtgaacatcaatacttgttccctatatacgacacttgataattaagatgatcaagaac

SEQ ID NO: 55323 - DNA, 283 bp, Homo sapiens
  misc_feature 23: n = A,T,C or G
cagcatacagtttggcttttttncattgatcatttttatatgaaataaaaagatcctgcatttatggtgtagttctgagtcccgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctg

SEQ ID NO: 55324 - DNA, 474 bp, Homo sapiens
  misc_feature 369: n = A,T,C or G
ggatcattttgttttaaagcaaaccgggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgcttggaagaacaagagccttggaggtnggaagtgctggaaggatgacatgtctgcagttgagttcaggcagacgggctacatgctgagatgttccctgtctcacgccatcactctggaattttatcaggatg

SEQ ID NO: 55325 - DNA, 300 bp, Homo sapiens
  misc_feature 3, 15: n = A,T,C or G
ccngggaattcggcnttatggccgaggaatactgaaaagaaatacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtctctttaagaaagtacttg

SEQ ID NO: 55326 - DNA, 473 bp, Homo sapiens
aaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagggttttggcagtaaaatactc

SEQ ID NO: 55327 - DNA, 474 bp, Homo sapiens
atgtaaaagctgtacaagaatattcttaccttctggaaattcaatcaaagccctaaccactctcacagtaccagcaacactaaagcagctggtaaatgcaagatgattctggccctgagaccagactaaatcaagtgccaaaggtcccataggatctttcaaagacgttgcacaggtaagagtccttcaagtaacaacactgaaaggggatggaaaaggagacacttaaaacaaagtgcccctttacagtgctggccacatctcacacaaccctgcatcaaagccctgcccagctgtccctgttatgagctcaagagcccaaacagacatactgtcagtcagggaaagatgttcggaaataagaaataaactgtgctacaagcaacaatctatcaaatccagaagaactaggactacctatgattctcttgttgaaccctgtgtagttaagcaccaaacagcagagagaactta

SEQ ID NO: 55328 - DNA, 473 bp, Homo sapiens
gaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcgtctctagaagctgggatggacttactattcttgttatatttttagatcctggaaaggtgctatgcttctgtt

SEQ ID NO: 55329 - DNA, 471 bp, Homo sapiens
tagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctg

SEQ ID NO: 55330 - DNA, 278 bp, Homo sapiens
gcatgcctgtagtcccagctatttaggaggcagaggcagaatagcttgaacccgggaagtggaggttgcagtgagccgagatcatgccactgcactccagcctgggagacagagtgagactcttccaaaaaaaaaagtttttcagaggcaaatcacagctattgacccaagagtggctcacacctgtaatctcagcactttgggaggccaaggcaggcagatcacctgaggtcgggagttccagaccagcctgaccaacgtggagaaacaccgtctct

SEQ ID NO: 55331 - DNA, 362 bp, Homo sapiens
tggataccatggggatcattaggtggctggaaaagggagaagggctgtgggtttgtgtaacatttcagaccaccttgaacacaggctcgaacctggtaaccctgcagaacagggtgatactcatacccaatcagggaagatagtaagataatgaggccccagcaagaagacttgcttgatcttaggtactccttgggaacttttgtctttaggcattttaaaaaatctgattacacattttctatcatttcaccactcagaaataagcatgcttaactttctggtgtattcctttcttcgctgatatatattgttactatgtgctagtatatactgtttccatataaaatatatatatactg

SEQ ID NO: 55332 - DNA, 432 bp, Homo sapiens
  misc_feature 278, 332, 340, 358: n = A,T,C or G
ataaactgctgtgcaaaaacagcaaataggggggctggtgagatggctcagtgggtaagagcacccgactgctcttccgaaggtccagagttcaaatcccagcaaccacatggtggctcacaaccatccgcaacaagatctgactccctcttctggagtgtctgaagacagctacagtgtacttacatatattaataaaataaatctttaaaaaaaaaaacagcaaatagttgtatcttttaaatgcatcacattattatacaagaaatactttcctnttctaaaaggaaaaatgtaaattatactgtaaaacacttatggttttatttagngaaatttntttaagttaacttgtagngattggatgtatttaaactgaattcacaggttgactaaaagtcaaatgtgaaaattacagtttttttgaattct

SEQ ID NO: 55333 - DNA, 470 bp, Homo sapiens
ggcatttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattagattctatt

SEQ ID NO: 55334 - DNA, 459 bp, Homo sapiens
  misc_feature 457: n = A,T,C or G
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtgggggngg

SEQ ID NO: 55335 - DNA, 224 bp, Homo sapiens
  misc_feature 224: n = A,T,C or G
tgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagctn

SEQ ID NO: 55336 - DNA, 128 bp, Homo sapiens
agataaaaaatgatgtaattgcagctggtaggatgtctggtgccaatccaggaagtgagagccatttcttttgtaccggatttaatgactttgaactgtgctgtaaataaataatacagctggacctg

SEQ ID NO: 55337 - DNA, 340 bp, Homo sapiens
gggcccagggtatgttcacggggcgatgctgccctcccagctggcccatgggtgaccctgggaacattaactgcctcacaacgtttgtgcctcagttacccgtagatgtagtgagggtaacaatacttactctcgttggtgataaggaacagctaacacaacacacagggtttttctgctcccaaaatgggattcttcagtgcaccaaatcgaagaaagcactggagctcacgctggtttctccattgtttctccttaacagtggaaactgtaacttttgttctagtagcatctagcatgctcaataattatttgtaaataaaagttatactttccctct

SEQ ID NO: 55338 - DNA, 470 bp, Homo sapiens
  misc_feature 421, 428: n = A,T,C or G
aggggtgctgttgctatcatggctgaccccgacccccggtaccctcgctcctcgatcgaggacgacttcaactatggcagcggcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcaagttgttgttactttctatgatgtatatattattctgcaagctttcatactgactactacaganttttttnggtttgactgtgtatactctacaatctaagaaggatttcagc

SEQ ID NO: 55339 - DNA, 167 bp, Homo sapiens
  misc_feature 31: n = A,T,C or G
gtatatataatgaaaagctcttgtttttttnatgtatattgacaatggatttttgctttgaattttagacaaataatgcattttagtgtaactaaattgaaagcaccaaacactactactaattttagttttgtttaactattcaaattttgtaggttgttttagac

SEQ ID NO: 55340 - DNA, 442 bp, Homo sapiens
  misc_feature 428, 439: n = A,T,C or G
gaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatacnttataagtttnagg

SEQ ID NO: 55341 - DNA, 423 bp, Homo sapiens
  misc_feature 12, 30, 48, 73, 78, 83, 84: n = A,T,C or G
attatggcgggngagaggagctacatgttnaggaactagtaaaagctncaccataccccccaccctaaccccntgatnagcgnntgggaatatttattttacattaaaaaatgagcagaagaaaagcattacacttgaactctatataaagttattccaaaaaaaggaaatacggagcagcactcataaaagagttgaacactatatacctgatattttaaaataagactaaaatatgagaatgtgatagatggtatgaaagaacgttatacattagttttagagaaactcagaaatgccagaattgaagagaaagatggcaggatttgggaaagaagtagaaataaaataatgtctcagaaattaagaataaattaggaaagaatgcaagagcaagtagaggaggagaagattttaataatc

SEQ ID NO: 55342 - DNA, 453 bp, Homo sapiens
aatgaatcttaacctttaagtgggcaatgatttcttagacatacagaaccaaactgtgaaagaaaaaataaaccagctgtacatcatccaaattaaaaacttttgatcttcaaaagtcactgttaacacaattcctatcaaaatcttagcattattttttgtagacatggacaaatttattctaaaatgtatatagaattatgaagtaactggaaacaattttgagtaagaagaatagagctgaaaaaaatcacaccactagattctaactaagacgtaacatacagcattatactcaggacactgtggtattgatcaaaagatagatcagtgaaacagaattaaaagtccagaagtagacccgtacaagtagagccaactgaagtttgacaaagatgcaaaagtaattcagtggggagaaatgatgctttttgcaacaaatggtattagtat

SEQ ID NO: 55343 - DNA, 472 bp, Homo sapiens
ggagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctc

SEQ ID NO: 55344 - DNA, 415 bp, Homo sapiens
  misc_feature 375, 413: n = A,T,C or G
gttgttaacatgaagggatgttgaattttatcgaaggctttttctgcatctattgagataatcatgtggtttctgtctttagctctcaaacgtaacagcttttagggtgtttttcagaatgctaagctgcagtatttgggaaaaataagaggtaggactttcaagagtttatttttagaacattagcaaacagtgaagtgttgttgagtttgaaatttgtataaaatttcttttattgatttactatactgaaaattctgctaatatgtcatttcttctcaagaaaatttcctggcaatgcccttgcctctggcagaagctaccatcctccaagtctgatcctatccatatcctctattggcacttacttctcanaagtataattacttttaacatgtcatatccattatganac

SEQ ID NO: 55345 - DNA, 369 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaagg

SEQ ID NO: 55346 - DNA, 370 bp, Homo sapiens
ggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggattcccaaggcatctccccagagcgagcctttgctgattttctctttgccagcaccatcctgca

SEQ ID NO: 55347 - DNA, 274 bp, Homo sapiens
gctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagc

SEQ ID NO: 55348 - DNA, 224 bp, Homo sapiens
  misc_feature 2: n = A,T,C or G
tngccggggagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaat

SEQ ID NO: 55349 - DNA, 372 bp, Homo sapiens
  misc_feature 364: n = A,T,C or G
ggaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggtacaaccctgagaatcacaagcggtgtggtggtgtgtcantgtggcct

SEQ ID NO: 55350 - DNA, 201 bp, Homo sapiens
catattaagaagcatgtgatgtcagtcatctccatttttagtgatgctaagtttaattgcttggttaagagggcatctgacacatgtctccactatgcaggtgtgtgttacccttgcaatcactaaggcatgcttggagagatacatggaactctgtgaatattctcctatttcccacattgactttttaaagtaaagggt

SEQ ID NO: 55351 - DNA, 372 bp, Homo sapiens
  misc_feature 5, 43: n = A,T,C or G
cattnaatgctttttgttttatttttttaccaattccaatttnaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaat

SEQ ID NO: 55352 - DNA, 370 bp, Homo sapiens
  misc_feature 366: n = A,T,C or G
gttcttgtagatggctgctctaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctncccc

SEQ ID NO: 55353 - DNA, 380 bp, Homo sapiens
gttcttgtagatggctgctctaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttga

SEQ ID NO: 55354 - DNA, 381 bp, Homo sapiens
  misc_feature 6: n = A,T,C or G
aaagangaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaat

SEQ ID NO: 55355 - DNA, 294 bp, Homo sapiens
gcagtgggacaagtatgtggaggtagaagacagtgatgttgatgatccttatcctgtgtaggcctaggctaatgtatgggtttctgtcttagtttttaacaaaaaagtttaaaaagttaattttaaaaagctagaaaaaacttacagaataaggatataaagaaagaaaatattcttctacagttgtaaaatatgttggtgttttaagctgagcattattacaaaaagtcaaaaagcttaaagaaattaaaacgtttataaaataaacatgttacaataaactaaggttattat

SEQ ID NO: 55356 - DNA, 296 bp, Homo sapiens
  misc_feature 255: n = A,T,C or G
ataggtttggtcctagcctttctattagctcttagtaagattacacgtgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggncacacgattaacccaagtcaatagaagccggcgtaaagagt

SEQ ID NO: 55357 - DNA, 367 bp, Homo sapiens
  misc_feature 4: n = A,T,C or G
atgntgcggccacagaatgcaacaagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagat

SEQ ID NO: 55358 - DNA, 366 bp, Homo sapiens
  misc_feature 14, 48: n = A,T,C or G
gaatctttgcaagnaagagattgcctttttgaagaaactccacgaagnaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtg

SEQ ID NO: 55359 - DNA, 224 bp, Homo sapiens
atttgagaagggttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcg

SEQ ID NO: 55360 - DNA, 371 bp, Homo sapiens
gggggcgcaagggaggtttcgagcccggtaaggtccggcgcccagaagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacgtgtaaggattgaaaggcttgtaatccaaagttactttgtacagaccttgaagattgaaaaaagcacgtctaaagagccagttgattttgagcaatggattgaaaaagatttggtacacacagagg

SEQ ID NO: 55361 - DNA, 345 bp, Homo sapiens
cttgacattaaaagttctggctaactttgggatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctca

SEQ ID NO: 55362 - DNA, 372 bp, Homo sapiens
  misc_feature 28: n = A,T,C or G
actgacttattttatgacaagaaatttnaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtggaagagtgcattacactattcttattctttagtaacttgggtagtactgtaatatttttaatcatcttaaagtat

SEQ ID NO: 55363 - DNA, 169 bp, Homo sapiens
tccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 55364 - DNA, 400 bp, Homo sapiens
  misc_feature 3, 7: n = A,T,C or G
agnaagnagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaaca

SEQ ID NO: 55365 - DNA, 178 bp, Homo sapiens
gaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatat

SEQ ID NO: 55366 - DNA, 372 bp, Homo sapiens
cactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttaccgttcctgccttccactgtgtttct

SEQ ID NO: 55367 - DNA, 399 bp, Homo sapiens
  misc_feature 16: n = A,T,C or G
cccggggaattcggcnttatggccgggagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtc

SEQ ID NO: 55368 - DNA, 370 bp, Homo sapiens
ggaagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagcca

SEQ ID NO: 55369 - DNA, 267 bp, Homo sapiens
gcttagaaggtgggtaacaacaaactcctctgagctaaaggagcatgttctaacccaatgcaaggaagctaagaacgttgaaaaaaggtgagagaaattgcaaactagaataatcagtttagagcagaacacaaatgacctgaaggagctgaaaaacacagcacgagaacttcatgaagcatacacaagtatcaatagctaaatcgatcaagcagaagaaaggatatcagagattgaagatcattttaatgaaataaagcatgaaga

SEQ ID NO: 55370 - DNA, 325 bp, Homo sapiens
ggtaagatagaattaggcctctctggaagcattacttccgaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttca

SEQ ID NO: 55371 - DNA, 376 bp, Homo sapiens
  misc_feature 206: n = A,T,C or G
gcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggngtgaagatgtgaataattgcacatggttttgagaacaggaactgtaaatctgttgcccaatcttaacatttttgagctgcatttaagtagactttggaccgttaagctgggcaaaggaagtgacaaggggaccggggtctgtgagagtcaattcaggggaaagatacaag

SEQ ID NO: 55372 - DNA, 149 bp, Homo sapiens
  misc_feature 2, 14: n = A,T,C or G
gncttatggcgggnctagtctgttacgttaacatgcttttctaaaattgcttcacgtgttaattcatttactcctgcattcattgactggttttgttcttttccattcactttgtacttatttttttcattaaattttgcatttatttt

SEQ ID NO: 55373 - DNA, 283 bp, Homo sapiens
  misc_feature 44: n = A,T,C or G
aaagtttgttgaaaacaaaaacgccttttcttggttcttttttnagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgtg

SEQ ID NO: 55374 - DNA, 372 bp, Homo sapiens
ggattaataggttttcatgggattgggactggaaggagaggaagagagacctgagctggcatgctcagtccccttgccatgtgaaaccttgtgccaactttggactctgtggagggtccccaccagcaagaaggtgctcaccagatgcagccccttgaccttagatttcttagcctccgtaactgtaagaaagtttcaggtattctgttataagcaacagaaaatggactaggcagcatgtaaaccaaattaatcaacatacacaaatttttgtagcactattttactcttttatataacaaataaagccttaaaacaaatactattttgaaagaaacttacatgaaatggtcataagcataatttaaactt

SEQ ID NO: 55375 - DNA, 343 bp, Homo sapiens
agatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactctttccatggaataaatgttggaaagctgatcttttctgatat

SEQ ID NO: 55376 - DNA, 369 bp, Homo sapiens
gagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccgcacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctat

SEQ ID NO: 55377 - DNA, 296 bp, Homo sapiens
attaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgag

SEQ ID NO: 55378 - DNA, 164 bp, Homo sapiens
tataaaaatgtagctgtagtttttttaaagaatgaaaattagacttggaataaaaatgatagtatccaataagaaatgtaaattagtggaaatgacaaaatatagaggaacaaaatgtgttacggtaatgagaatttctaatgtaaattggtgtaatgtcaatg

SEQ ID NO: 55379 - DNA, 372 bp, Homo sapiens
tatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataag

SEQ ID NO: 55380 - DNA, 227 bp, Homo sapiens
gtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacat

SEQ ID NO: 55381 - DNA, 246 bp, Homo sapiens
atagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacag

SEQ ID NO: 55382 - DNA, 341 bp, Homo sapiens
  misc_feature 8, 10: n = A,T,C or G
tctctatngnttatggcgcggggcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttt

SEQ ID NO: 55383 - DNA, 367 bp, Homo sapiens
catcaaaatgcatgaaaggaaaaaactgatagggagagatagacagttctgtgataatgaagttggagacttataccgcctctcaatgatggatagaagataagtaaggaaacagaggacttaataaactaactagatctaaaagatatatttaagaatattctacccaacaaaagtgtacacattcttctcaagtacacatgggacattttccaggataggcaatatgttagaccacagattgagtctcaatagttttttaaagatagatatcatacaaagtgtattctccagccacaatggggtaaagttagaaatgagagacagaagtaaaactggacaattcacaaaattgtggaaattacac

SEQ ID NO: 55384 - DNA, 373 bp, Homo sapiens
gacttccctgaatttctgacaatgatggcaagaaaaatgaaagacacagtacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgta

SEQ ID NO: 55385 - DNA, 376 bp, Homo sapiens
accgctcagtattttaaatgaagtgattctaagatttggtttgggatcaataggaaagcatatgctgccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgtgtga

SEQ ID NO: 55386 - DNA, 376 bp, Homo sapiens
gtctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtat

SEQ ID NO: 55387 - DNA, 293 bp, Homo sapiens
gttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaac

SEQ ID NO: 55388 - DNA, 372 bp, Homo sapiens
  misc_feature 12: n = A,T,C or G
ggaaactttagnaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaag

SEQ ID NO: 55389 - DNA, 383 bp, Homo sapiens
tgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcat

SEQ ID NO: 55390 - DNA, 156 bp, Homo sapiens
  misc_feature 156: n = A,T,C or G
gtgctgggagtgaagagtggcttagctatttacccgctctttgggacagggcaaactaaatgcatcccttcttacctaactcccaacccctgccctgggctgaggcatatgaatgctatagttgtgcattaaaataaatgttttttatctcctggn

SEQ ID NO: 55391 - DNA, 369 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 55392 - DNA, 370 bp, Homo sapiens
catcactgtgatccacacactggtaaaggcatgatccacacactggtaaaggcacagaaaaatgttccttccatttgtagacatacttgcagatgcagggacttaattcagggatcaatgttgtataaaaagaatccggagtttgaccaactcaccttcccagctacaaatggcatatcacccaagcataatctataatgtggttgtgcaccaaaatagttcctagaacttttctgaatgaaaagaaaaggaaaacaattttattttattcacatgataataaaaactgactatacatgactaacttgaaacttcagttaactactaggctactacttgccttatctatagttggcattatgatcacaag

SEQ ID NO: 55393 - DNA, 363 bp, Homo sapiens
  misc_feature 50: n = A,T,C or G
gggcattcctgttacagaccaaggagaactggagaaagaaagagaaaatnagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaag

SEQ ID NO: 55394 - DNA, 372 bp, Homo sapiens
catctcagaaaccgtcttccccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagtt

SEQ ID NO: 55395 - DNA, 366 bp, Homo sapiens
atgcactaggatttctactggaggtggagaaacagaagaaactctgaagaaattgttacaagaagacacacccgtgaggaagttgcaagccaacaaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatat

SEQ ID NO: 55396 - DNA, 372 bp, Homo sapiens
ataggatgtaaacagaaagctacatgcatatgactagtaatacaaattattaagtaaaaattcaggataaacatggcttgcacttctcacaaatcattcacaattatggtaggagaacagggcacctaaaagactaatccctatcaggcaccaacagcatatcttggcacaagatgatcaagtgatttcagctgagtaatttaaatgcatcttccaagtcacttgggtaccatgacagccatggcaataatggagtttatcctagtaactgttctaaattgacacttcatgtacacattacagacatggtaaacttcgattttctgctttacaaccttgtagccagccacgacatgtgctcttggttccagt

SEQ ID NO: 55397 - DNA, 372 bp, Homo sapiens
atctacagaaacatatattatttttattgtgtacctaaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggat

SEQ ID NO: 55398 - DNA, 331 bp, Homo sapiens
ggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagat

SEQ ID NO: 55399 - DNA, 351 bp, Homo sapiens
  misc_feature 7: n = A,T,C or G
catgacnatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaat

SEQ ID NO: 55400 - DNA, 372 bp, Homo sapiens
catccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctac

SEQ ID NO: 55401 - DNA, 372 bp, Homo sapiens
  misc_feature 40: n = A,T,C or G
gtaagtaatacactgataatgaattttgacaacttgagtnactgaagagttggacctaatgttgcttaccccaggctatataagtgaaattgagtgaaatgtgaaatgtttgatttagaatatagtgattgtatttgttcttttaaatttatatttcttgataatcatactgaatactttcatgaatggtgtgccagatactcttttcagactatgcatcttttgctgttattaaatttattaaattttcataagggtaaaacaagttgacacatttataaagttataaattaagaagtactgtatatttggtaaacaaaaatgactggcttttcaaccaccccctagtcaaatccaccacagactttcctg

SEQ ID NO: 55402 - DNA, 372 bp, Homo sapiens
tgagcttaatagatagccgactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgca

SEQ ID NO: 55403 - DNA, 372 bp, Homo sapiens
gaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcat

SEQ ID NO: 55404 - DNA, 215 bp, Homo sapiens
  misc_feature 13, 18, 36, 49, 51, 61: n = A,T,C or G
cggcccatgaggntctgngagcaggcagctatctgnactctaaactgcnancagaaatcangtgcctaagactgaatgttttatttatcaaaatgtagcttttggggagggaggggaaatgtaatactggaataatttgcaaatgattttaattttatattcagtgaaaagattttatttatggaattaaccatttaataaagaaatatttacct

SEQ ID NO: 55405 - DNA, 370 bp, Homo sapiens
gacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagt

SEQ ID NO: 55406 - DNA, 364 bp, Homo sapiens
  misc_feature 13: n = A,T,C or G
caggaagctgagnaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcacaagctgtaccagagtgcaggaggcatgccaggaggaatgcctgggggatttcctggtggtggagctcctccctctggtggtgcttcctcagggccca

SEQ ID NO: 55407 - DNA, 389 bp, Homo sapiens
  misc_feature 6, 45, 47: n = A,T,C or G
ccgggnattcggccttatggccggggaaccgtgagatgaaacagnanagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcaga

SEQ ID NO: 55408 - DNA, 370 bp, Homo sapiens
gctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttg

SEQ ID NO: 55409 - DNA, 373 bp, Homo sapiens
gaaaacacatttcataaatttcctactgattattaatacgccatttgttttgttatgaaaaatatccaggtaaacctagaacagataactgtctaaagagaaagttataatactttaccaaatatttggataaatcataataatgctgatgtgtataatcaaggaaaatttattctctaaaatattgagtacttctctattctctaatgtttctgtgcatattaaatattttgttcaatgtgattaatcaatgacttgtcaaccattttccaaggttattatattgcctcctttcagcttttatgtatacacttcgtgttttttaattcacccagatcctcttacttacagttgcattgctaattttatgttt

SEQ ID NO: 55410 - DNA, 316 bp, Homo sapiens
ggtgagtgacgtcgtggcgggtcactcactcggggatcgccgattgcgatcgtaggggtcttccttctctaacttgcctccaggagagaggacctggcctgcgctgctaatgggtagtccgttcgcagcaggaccagccctggcctaaggaagaaggaggaggagaagaaggaagaagaaaagaaggagaagaaagaagaaggaagaagaaagaacaacaaaaagaaggaggaggaagaaggagaagaaggaagaataaggaagaaggagaacaaggagaaggaagaagaaaagaaggagaaggaggaagaaggag

SEQ ID NO: 55411 - DNA, 363 bp, Homo sapiens
aagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttg

SEQ ID NO: 55412 - DNA, 372 bp, Homo sapiens
gtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattacca

SEQ ID NO: 55413 - DNA, 288 bp, Homo sapiens
  misc_feature 209, 287, 288: n = A,T,C or G
ctattaaaacgaaaaacagattcagaagaaaaaaataagacatgttgtatatgtttttgtatgtttatttgtttgttgttattaaaaaaaaaattgacactgaaaaaagtggactaagaataaaaaatatattttttattctgtatatatggaaatcaagataccaatatgttgcattgctttgttgtacaaatcaaaaatgtgcttgnggctattttttttaatctaatttattctacagtattttgtcctttgcttcaccattaaagttaaaaggttgtcccctnn

SEQ ID NO: 55414 - DNA, 398 bp, Homo sapiens
  misc_feature 5, 17: n = A,T,C or G
acccngggaattcggcnttatggccggagacattgccaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgtttgatggccgccatcctcatgacatcatcgatgacatcaacagtggtgctgtggaatgcccagccagttaagcac

SEQ ID NO: 55415 - DNA, 372 bp, Homo sapiens
gctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacaga

SEQ ID NO: 55416 - DNA, 386 bp, Homo sapiens
ataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcag

SEQ ID NO: 55417 - DNA, 372 bp, Homo sapiens
gtatctgcagtgcgtggcacaatgtaaattttaaatgaatgaacacaaatgaattgtatttccacaattttgaatcttggtatagtggaaagaatattactctggaggtcaaggggctgtagttcttgtcttctccatgaatattctttatgtgccacttctaccatctgtgaaatgagggatgggagggggaacttgaggaagtggtattagatgatcattaatagtcctgtcagcatattattgtagggttttatgaatattataattgcattttagaccataataaccaaacattacatattgatatatttaatttttttatttaagtggtacatgatcagcattgtccacatttacaatcgatggaga

SEQ ID NO: 55418 - DNA, 368 bp, Homo sapiens
  misc_feature 7: n = A,T,C or G
ggaattnacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataatt

SEQ ID NO: 55419 - DNA, 372 bp, Homo sapiens
  misc_feature 11: n = A,T,C or G
gagtttattcngtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggaca

SEQ ID NO: 55420 - DNA, 372 bp, Homo sapiens
ggggaaaacaattagccaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcatttt

SEQ ID NO: 55421 - DNA, 138 bp, Homo sapiens
gtctaaaaccacagataataacaaaccttatacatactgttttttcctatgcatacatacctgtgattaagtttatgaattaggcaccttaagagattgacaacaataactaataataaaatgtaacggttatactgc

SEQ ID NO: 55422 - DNA, 372 bp, Homo sapiens
tacatacagctacacacacacataaatgactgaattaaataatactgaaggccataggtttattacatattattcttttttattttcttaataggctgggcaagtactgaattgtgatttacatattttaagacatttctgtataatttgagtatgtccaaattgaagttattaactcttgaccattaggactctgttaagaacagtctttctatttaatgtctacatggcatttctcagatagatacattatctttatacagcagcaaattctatgagcttagaatattttgttttatcttctaattatcagtattggatttaggtgtacattacttttctgcaatggactggtggatttgttttattttc

SEQ ID NO: 55423 - DNA, 375 bp, Homo sapiens
  misc_feature 11: n = A,T,C or G
gctatcccggnagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaatt

SEQ ID NO: 55424 - DNA, 126 bp, Homo sapiens
  misc_feature 15, 16, 50, 71, 75, 85, 107: n = A,T,C or G
gccccactcttaatnngtggtggaagaacggtctcagaactgtttgtttnaattggccctttaagtttacnaccnaaagactggntaatgataacaatgcatcgcanaaccttcacaaggaaagga

SEQ ID NO: 55425 - DNA, 370 bp, Homo sapiens
  misc_feature 11, 16: n = A,T,C or G
caataccaagnacagnaaatatgttgtgataggaaatcagaaaatagcaacaaagaaacaatttatagaaaaatcagagatattaattttatattgaggtgctacccaaaggtgttttttaaatgaagggaaaataaaagaacaaaagaaataattcaatttgataatatcacaaacgacaaatagaaaaagttattacctttattctttgcatttaaaactttaaaaatgaaatgtgagttgggtgaatgtgaataaaagcaaatatgactgttacgctactggcagcaaataaataacttcttttctcagtggcatattattccagtaaacaccaatgaatggtctaaaaagataccaatgaggtcat

SEQ ID NO: 55426 - DNA, 362 bp, Homo sapiens
  misc_feature 1, 6: n = A,T,C or G
ntgggncggggggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagccaggtatggtggtgtgcgcctattgtcccatctacttgagaggctgaggcaggagggattgcttgggctcaggattttgaatccagcctgggcaacatagcaagaccccatctctaataaataaat

SEQ ID NO: 55427 - DNA, 271 bp, Homo sapiens
acagtcgatacatgagagacaagttggataccttagttgattttcctatcaagtaagctttaattgtactttataagcattgggcaactcttctttcaaacttatttgatgctttttgttattatcctttagtaaacatcaggtgccattggacccaatttcagctttcaagtttgtttttgagtagttctaacagtttataaggatcagtgtttcaaaatttttattttttcttagagattttccaaagatcaaagagaaaatatacttt

SEQ ID NO: 55428 - DNA, 315 bp, Homo sapiens
  misc_feature 267, 299, 302: n = A,T,C or G
gcctttcggccggaaccgccatcttccagtaattcgccaaaatgacgaacacaaagggaaagaggagaggcatccgatatatgttctctaggccttttagaaaacatggagttgttcctttggccacatatatgcgaatctataagaaaggtgatattgtagacatcaagggaatgggtactgttcaaaaagggaatgcccccccaagtgttaccatggcaaaactggaagagtctacaatgttacccacctgctggtggcatttgntgaaacaaacaagttaagggcaagaattcttnccnaagaaaattaatg

SEQ ID NO: 55429 - DNA, 332 bp, Homo sapiens
gaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaata

SEQ ID NO: 55430 - DNA, 372 bp, Homo sapiens; identical to SEQ ID NO: 54936

SEQ ID NO: 55431 - DNA, 186 bp, Homo sapiens
gattataatagtcagaagaaataaaaaaggaagtcaagaaatgccttgatacaaacgaaaatgaaaacaatgtatagaaacttatgggatgccccaaaaacagttctaaaagggaaattcatagcaataaatgcctatatccaaaaagaagagagttcaaataaacaatctaacatctgacttcac

SEQ ID NO: 55432 - DNA, 361 bp, Homo sapiens
  misc_feature 2, 18, 119, 327: n = A,T,C or G
gnacgctgccttcaaagnacctggatgtggccattcttgtgggctccatgccaagaagggaaggcatggagagaaaagatttactgaaagcaaatgtgaaaatcttcaaatcccagggngcaagccttagataaatacgccaagaagtcagttaaggttattgttgtgggtaatccagccaataccaactgcctgactgcttccaagtcagcctccatccatccccaaggagaacttcagttgcttgactcgtttggatcacaacccgagctaaagctcaaattgctcttaaacttggggtgactgctaatgatgtaaagaatgtcnttatctggggaaaccattcctcgacctcagtatg

SEQ ID NO: 55433 - DNA, 400 bp, Homo sapiens
  misc_feature 11, 12, 27, 314, 362: n = A,T,C or G
acggggaattnngccttatgggggggnatttctaaaaccttaaaaccactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggnggtttgagccttgattagacttttgatgtgctaagccagacaggcagnctgtacattgatggccatcacaatgcagctttggttta

SEQ ID NO: 55434 - DNA, 289 bp, Homo sapiens
gtttgtagttgttgctgtttttgagacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttatgaatttcatacaatcttca

SEQ ID NO: 55435 - DNA, 397 bp, Homo sapiens
  misc_feature 1, 10: n = A,T,C or G
ntgggggggncccaaataaagtataggcgatagaaattgaaacctggcgcaatagatatagtaccgcaagggaaagatgaagaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctt

SEQ ID NO: 55436 - DNA, 372 bp, Homo sapiens
  misc_feature 23: n = A,T,C or G
gcaacttatgaaagtagacattngatccgccttactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagcatgtctcttaaccagttcacttattgtactctggcaatttaaaagaaaatcagtaaaatattttgcttgtaaaatgcttaatatcgtgcctaggttatgtggtgactattttgaatcaaaaatgtattgaatca

SEQ ID NO: 55437 - DNA, 234 bp, Homo sapiens
  misc_feature 2, 12, 54, 91: n = A,T,C or G
ancggggaattnggcattatgggcgggagaattgaagttaacattcttattttnagagaatttatggacgttgtagaaatgtacaaatgcntttccaaactgccttaaacgttgtatttttatagacatgttttttaaaaatcctaagtttttaaataactacggatttgtgtattttttttggttatttgttttattaaaacatgtacatcagtaaagagttttaaacaatgg

SEQ ID NO: 55438 - DNA, 186 bp, Homo sapiens
  misc_feature 64: n = A,T,C or G
gaagataaggcccaaaacaacctgaaaacaaataataaaatggcagagtaagttcttacttatnaagaataatataaatgtaaatggactaaactgtccagccaaaagacatagagtggctgaatagatgtaaaaaacccattgccttgttgcttaccagaaacacacttcacctataaagacaca

SEQ ID NO: 55439 - DNA, 372 bp, Homo sapiens
gcttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaaggaggttaagctggctgtcctgaaatattataaggtggatgagaat

SEQ ID NO: 55440 - DNA, 372 bp, Homo sapiens
atagcactttaagttattctaaaaatgaaattataagccaatatttggcttaagtagatttagttgtatagcacttacatatttagttcttttgaaagtttagataattatttaaaaaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctacta

SEQ ID NO: 55441 - DNA, 297 bp, Homo sapiens
gaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 55442 - DNA, 312 bp, Homo sapiens
ggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgccttttccctgtgtgaattttgtatctagcctaaagtttccctaggctttcttgtctcagcaactttcccatcttgtctctcttggatgatgtttgccgtcagcattcaccaaataaacttgctctctgg

SEQ ID NO: 55443 - DNA, 252 bp, Homo sapiens
acaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttg

SEQ ID NO: 55444 - DNA, 330 bp, Homo sapiens
cattcacaagacgcatccatggagtgggcttcaagaagcgtgcacctcgggcactcaaagagattcggaaatttgccctgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaat

SEQ ID NO: 55445 - DNA, 130 bp, Homo sapiens
caaaaaatgggagacaatttcacatggactttggaaaatatttttttcctttgcattcatctctcaaacttagtttttatctttgaccaaccgaacatgaccaaaaaccaaaagtgcattcaaccttacc

SEQ ID NO: 55446 - DNA, 400 bp, Homo sapiens
  misc_feature 5, 9, 32: n = A,T,C or G
tgggngggntattttaaaacaatgtttaagcncattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaat

SEQ ID NO: 55447 - DNA, 134 bp, Homo sapiens
gtgcatacagtttattaactccttccctcgctcccccaaaaatttgaatttttttttcaacactcttacacctgttatggaaaatgtcaacctttgtaagaaaaccaaaataaaaattgaaaaataaaaaccct

SEQ ID NO: 55448 - DNA, 371 bp, Homo sapiens
gcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttg

SEQ ID NO: 55449 - DNA, 102 bp, Homo sapiens
agctgaggaggagaattacttgaacccaggaggcggaggttacagtaagccaagatcatgccactgcactccagcctgggtgacagagggagactccatctc

SEQ ID NO: 55450 - DNA, 372 bp, Homo sapiens
gggatgtgagattttgcttttcccatctttttgaagctgatcagcagatacataagaacctggaagaagctgctcaattaaggttaaaaaaaataaaaagcaattgttagcaatgtggtgctgaaatcaagacttaactttgaagtgtcaagaatgataacctcccatccacttcatgtggtttttaagaataaattttatatatttctccaggtattaaagtttttgtttttctactcgtgccagttgtattaaaatgtcactaggttaaaaacaaacacagatatgtttattcattactgtatccctgtaataatgcctggcatgcagtaggtccctaatatttgttgaatgaatgaattatagaataga

SEQ ID NO: 55451 - DNA, 372 bp, Homo sapiens
aaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagacttcacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctcca

SEQ ID NO: 55452 - DNA, 372 bp, Homo sapiens
gacgatgagatattctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccag

SEQ ID NO: 55453 - DNA, 327 bp, Homo sapiens
gaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaat

SEQ ID NO: 55454 - DNA, 356 bp, Homo sapiens
gaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagct

SEQ ID NO: 55455 - DNA, 374 bp, Homo sapiens
ggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattca

SEQ ID NO: 55456 - DNA, 352 bp, Homo sapiens
gagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacg

SEQ ID NO: 55457 - DNA, 200 bp, Homo sapiens
aaggtaggagtttgagaccggtctagccaatatggtgaaaccccagctctactaaaaatacaaaaattagctgggcatggcggcgcacacctgtagtcccagctgctccagaggctgaggcaagagaatcgcttgaacccacgagggggaggttgcagtgagctgagatcatgccactgcactccaacctgggtgacaga

SEQ ID NO: 55458 - DNA, 320 bp, Homo sapiens
  misc_feature 317: n = A,T,C or G
atatggattgtagataatcctacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgccttttttttttaataaagaagaaatttanatt

SEQ ID NO: 55459 - DNA, 133 bp, Homo sapiens
ggaccaaaagtatagtgactatctgttcatgagagaaattttctgtaagcttgctgttttacaggggatttatcaataattgattttgaggaatcagtttttttctatggctaataaactttttaattcactt

SEQ ID NO: 55460 - DNA, 372 bp, Homo sapiens
gacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattag

SEQ ID NO: 55461 - DNA, 198 bp, Homo sapiens
  misc_feature 6: n = A,T,C or G
gagacnagcctgggcaacatagcaagactctttgtctacaaaaaagttttaaaaatcagtctgtggtgatggcacttacatgtagtcctagctgctagggtggctgaggcggaaaatcacttgagcccagaagttccaggctgcagtgagctgtgatcatgccactgcactctaggtgacagagcaagaacctgaatt

SEQ ID NO: 55462 - DNA, 190 bp, Homo sapiens
  misc_feature 3: n = A,T,C or G
acncaaaaccgctcaacttgctgtgctcatgaaaacagcaagagctggagggatgaagaagctagggaaggataacatccacttcacaagggaaagcagaactgtataaaaacggcatattctttattttgcatactttaatttcagaacaaaatgaagaaaataaaataaaccacaatacacaacatcc

SEQ ID NO: 55463 - DNA, 372 bp, Homo sapiens
  misc_feature 15: n = A,T,C or G
aattacaattatgtnatatttatgttttaatttaaaattgtgagagtttagagtcatgtaagcattaagaaagataaaatatctgaattatatatatttgcatatatgtgcatgtatatactattcaacttaacctttataaataagccttatttttattattcagattaattgttcattcttatataaaatgtgtctggcatttggtttttgctgggggagtacaataatacatggtatctgccttctgggaagaagtacagtaatgggtcaggaattaggacagtcactgtcagtcacagtcatcatctcagttaatcctccaaataacattatgatgctgggcattgtcaactcaattttattgatggc

SEQ ID NO: 55464 - DNA, 372 bp, Homo sapiens
gttataagggttcctgctttcacagaattattcagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcagagtgaaagaaggcatgaatattgtggaggccatggagcgctttgggtccaggaatggcaagaccagcaagaagatcaccattgctgactgtggacaactcgaataagtttgacttgtgtt

SEQ ID NO: 55465 - DNA, 205 bp, Homo sapiens
gacatggtgaaaccccgtctctactaaaaatacaaaaattagccaggcgtggtggcgtgcacctgtaatcccagctactcgagaggctaaggcaggagaatcgcttgaacctgggaggtggaggttgcagtgagccaagatcgtgccaccgcactccagcctgggcgacagaatgagattccgtctcaaaaaaaaaacttaaatt

SEQ ID NO: 55466 - DNA, 398 bp, Homo sapiens
  misc_feature 1, 2: n = A,T,C or G
nngggggggggggagaagatggctgccccagcagtgtccgggctctcccggcaggtgcgatgcttcagtacctctgcggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgc

SEQ ID NO: 55467 - DNA, 372 bp, Homo sapiens
tacagaaggcaattaagtcttaatttaatttggcagcttttaatgtggcaatctttgattctttattcttttagatggctgtgtgcaccaattaaagaatgcatcccatttgctaaagaaattaaaatttaaaagaaaaaaatcttaaacaatttaatactacatctcaaggaagtggaacaataacaacagactaaggccaaattaggcagaaagagggaattaacaaagatttgagcagaaatacatgaaacggaaaattcaaaaataatagaaaaaaataagacaactaggaattggttttactggttttttataaatataaactaaattggtaaaaccttaagtaaactaactagcaaaaaaaagagc

SEQ ID NO: 55468 - DNA, 153 bp, Homo sapiens
gaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagctt

SEQ ID NO: 55469 - DNA, 194 bp, Homo sapiens
agtatatgcagaagtagaaagtagcttaaaatatacccatgtgcttttagatggaggaaataggtgtaggttcagcgggacctatcataagactataatttgcagtgttttctaaccattttaattatggcatatttagactgagagctaaataaatggatcaagttcacttaggtagccttagctgacacacg

SEQ ID NO: 55470 - DNA, 400 bp, Homo sapiens
  misc_feature 13: n = A,T,C or G
atacggggaattnggccttatgggcgggggacatggtcctccaagttcttttccctcccttgagtgtggtggggcgtgtagtggttggcatcttgcaggctgccttgggctgatcctgccccagctgctgggggaccctggacaggtgacctcacaggtcctcggtttcctctgttgtagagtggggattagtcggacacaattcatagggttcttgagggcacagagagaccacgtgcaggctctttaccttgtacttgatctgtggtaaacatgatctaattcgtcatcactgtcattactataatcattactatatttggtcggcttctatgcatctgattatggtcaaaagatcctctgctttggaacacccagggtgctgccagggtgactccta

SEQ ID NO: 55471 - DNA, 238 bp, Homo sapiens
  misc_feature 226, 232: n = A,T,C or G
atatttttgtagcaagattaaatgtgtcattggaagccatccctttttttacatttcatacaacagaaaccagaaaagcaatactgtttccattttaaggatatgattaatattattaatataataatgatgatgatgatgaaaactaaggatttttcaagagatctttctttccaaaacatttctggacagtacctgattgtatttttttttttaaataaaagcncaagtnctttcg

SEQ ID NO: 55472 - DNA, 349 bp, Homo sapiens
aaggtaaaggtataaacaggtttgggggcttgtttatttttgtatagcaggctattcaaatcttttatgcacacagactttctacttctcaaaaagaccctgttgtgtatatctagcatacagctgcaagtctatgctttcatgctatgcattgtaggcaaaagtaacccatgataaaactgaggagaggctgatctaggggcttcccttggctccagtgtgcaaatataaaaatggcttttattgtgacccccctctgccccttcccctaatcttgatattgtcttgggtttttgaggaattggctagatatcagaggttaaagatgctaataaataaaacctgttca

SEQ ID NO: 55473 - DNA, 110 bp, Homo sapiens
ggttgttggaggagaggaagaaagagagacagaggattacattcatccgttacgttcttgaaatttcctaatagcaagaccagcgaagcggttgcacccttttcaatctt

SEQ ID NO: 55474 - DNA, 285 bp, Homo sapiens
cgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcct

SEQ ID NO: 55475 - DNA, 323 bp, Homo sapiens
  misc_feature 230: n = A,T,C or G
atttgtggttaaacatatatgcttcttgccccaaatgactacatctttgttttctgttcgggcaaacagagaactggagttcactgtgatctcttcactgttaacactatttaagtgttattcaaagaaaatggaaacttttggtctcagtgtcatgccaacttgttctagattattgttcttaaaaaaaaacaaaacaaaaaaaaacagagccccaggctggatgccgnggctcacgcctgtagtcccggcactttgggaggctgagacgggcagatcacaaggtcaggagatcgagaccgtcctggctaacaaggtgaaac

SEQ ID NO: 55476 - DNA, 400 bp, Homo sapiens
  misc_feature 13, 18: n = A,T,C or G
ctacggggaattnggccnttatgggcgggatattaataaaatatattgtacatagtggaaaattttaagtagctaatttaaaatttcagaaaatgctattaaagaattttgattcaagtatttaaactgtttagttatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttct

SEQ ID NO: 55477 - DNA, 372 bp, Homo sapiens
gctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgta

SEQ ID NO: 55478 - DNA, 269 bp, Homo sapiens
tgcttagcaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgaca

SEQ ID NO: 55479 - DNA, 255 bp, Homo sapiens
  misc_feature 17: n = A,T,C or G
tccccaaatcccctganacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattg

SEQ ID NO: 55480 - DNA, 276 bp, Homo sapiens
  misc_feature 39: n = A,T,C or G
atttcactaaatgtaaaatttggagtaaatatatatgtnaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 55481 - DNA, 471 bp, Homo sapiens
  misc_feature 10: n = A,T,C or G
gacataaagnagcttctgcaagatcctggggccattatcctactccaagatcaagcatttgcgtttggatggtaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatatttttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatctt

SEQ ID NO: 55482 - DNA, 334 bp, Homo sapiens
gcacaatatatgtaatgcacttgaatcatcctgaaattattccctcatccccagtctgtggaaaaattgtcttccacacattcactctgttttttggtagaggcagggtcttaatatattgcccagtctgatctcaaactcctggcctcaagtaatatacctctctcagcctcccaaagtgctgagattacaggcataagccaccaccctcaaccaagactttcttaaaccaaataaaaattaagtgagattacttgagcccaggtggtcaaggctgcagtgagcctgattgcaccactgcactccagcctaggtgacagaatgagactgtctc

SEQ ID NO: 55483 - DNA, 451 bp, Homo sapiens
ggagtgacggtggcgtttccttgagaagagtgagggttccaacttttctgcttatctgggaggtgttgggcgcggacagtcgagatgtcagagaaaaagcagcggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatat

SEQ ID NO: 55484 - DNA, 280 bp, Homo sapiens
  misc_feature 173: n = A,T,C or G
agtaacatgctgtttaggtttgtagcctaggagcaataggacataccatatagcctaggtgcgtgtagtaggctataccctaggtttgtgtaagtacactctttgatgtttgcgtaatgatgaagctgcctaacaatacatttctcagaacatatccctgtcatgaagcaacncatgactgtaaatgtaatcatacaatatgtgactttttatgtcttgtttcattcacttagcataatgtttttgaggttcattcatataatttttattatgtacaatg

SEQ ID NO: 55485 - DNA, 167 bp, Homo sapiens
gttgtttagaggtaaaatccgatctgtaaaagatcccaatttgaaaatctttattagctttttaaaaagaagattttgtcttcaccagctacagcaagggccctctcgatggtaggatgttcatgagaaagagaaaggaaggaaagaggagcccagtaaagacacac

SEQ ID NO: 55486 - DNA, 138 bp, Homo sapiens
gacttgaaagacttgtagatgtgtgatgttcaggcacaggatgctgaaagctatgttactattcttagtttgtaaattgtccttttgataccatcatcttgttttctttttgtaggtataaataaaaacactgttggc

SEQ ID NO: 55487 - DNA, 202 bp, Homo sapiens
gaagaaaaatttgaaatctggttaggctggtgttagggttctttgtttttggggtttggcagagatgtgtttaagtgctgtggccagaagcggggggagggggggtttggtggaaattttttgttatgatgtctgtgtggaaagcggctgtgcagacgttcaattgttattattatgtcctacaagcattaattaataaaac

SEQ ID NO: 55488 - DNA, 470 bp, Homo sapiens
gagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaatttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctcct

SEQ ID NO: 55489 - DNA, 264 bp, Homo sapiens
  misc_feature 10: n = A,T,C or G
gcactaaganaagtcggaatggaagaaattaccgtatgtaattcttattcacttaaaatctttgtgcgcataggccttagcactttgacaaataaactctgccttttagctcctcactattgtcttctttcctgtcacttttaggctgtttcattggtcgtataaaaacaaccttcttcgaagttgaatgtatgtttctgcacatagacaaaccatattttactgactcattctatgttgaataaaggcatacagttttaccct

SEQ ID NO: 55490 - DNA, 344 bp, Homo sapiens; identical to SEQ ID NO: 35399

SEQ ID NO: 55491 - DNA, 307 bp, Homo sapiens
  misc_feature 28: n = A,T,C or G
gcagggagggtgacaagcacaccctgancaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaataggggaagatggagacaccctctgggggtcctctctgagtcaaatccagtggtgggtaattgtacaataaattttttttggtcaaat

SEQ ID NO: 55492 - DNA, 369 bp, Homo sapiens
attttaaatgaagtgattctaagatttggtttgggatcaataggaaagcatatgcagccaaccaagatgcaaatgttttgaaatgatatgaccaaaaattttaagtaggaaagtcacccaaacacttctgctttcacctaagtgtctggcccgcaatactgtaggaacaagcatgatcttgttactgtgatattttaaatatccacagtactcactttttccaaatgatcctagtaattgcctagaaatatctttctcttacctgttgtttatcaatttttcccagtatttttatacggaaaaaattgtatttgaaaacacttagtatgcagttgataagaggaatttggtataattattgggggggtg

SEQ ID NO: 55493 - DNA, 287 bp, Homo sapiens
  misc_feature 2, 9, 46, 49: n = A,T,C or G
anccggggnaattcggccttatggccggaacagcccggcatccganaancgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgtttttttttctttttttaatggcagctaaagatatacagattactgttaaattgcagtc

SEQ ID NO: 55494 - DNA, 258 bp, Homo sapiens
  misc_feature 5: n = A,T,C or G
atacnaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatg

SEQ ID NO: 55495 - DNA, 473 bp, Homo sapiens
tgaaaaatagaatggttgtatgagtattcaaattatagtatctactgaatgcatatcacttttgcactattgcaaagttgaaagttgggaactgtctatatatatataaacatcatgttgtatactttaaatttatgcaataaaatatttaacaaagtaaaataaaataaaatacagttgattaaataatatgtttaatgtccaactgcaagataaaccaattcttttaggacccattatttctatgcctgttacatagcaatataagaaatagtgtgccagtgttctaagttatatactagaattatcttagaaatgtatttatgctaacataataatttcctttggtagccccacttaaattacttttctggaaatttgtcttgttctctcactctctagtaaatggtacttgttcaaggtcttgttagaatgacagcttcttcttgggataacttgagcatcaaaatgct

SEQ ID NO: 55496 - DNA, 224 bp, Homo sapiens
gtggatcacttgagctcaggagtttgagaccagcctgaccaacctggtgaaaccctgtctctactaaaaatacaaaatcagccaggtgtggtggcgcatgcctgtaatcccagctacttgggaggctgaagcacaattgcctgaaccagggaggcagaaattgcagtgagccaagatcgtgccattgcactccagcctgggcaacaagagtgaaacttcgtctc

SEQ ID NO: 55497 - DNA, 446 bp, Homo sapiens
gatcccataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaataggtgaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctg

SEQ ID NO: 55498 - DNA, 299 bp, Homo sapiens
cagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtgataatatgtcattgtacatgttgaaaggtttctacggtactaaaagtttgttttattttatcaaacattaagcttttttaagaaaataattgggcagtgaaataaatgtatcttcttgtctctgg

SEQ ID NO: 55499 - DNA, 412 bp, Homo sapiens
  misc_feature 108, 396: n = A,T,C or G
gattcatgagcacatggttattactgatcgcattgaaaacattgatcacctgggtttctttatttatcgactgtgtcatgacaaggaaacttacaaactgcaacgcanagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattatttttttaaagtcttctttcatgtaagtagcaaacagggctttactatcttttcatctcattaattcaattaaaaccattaccttaaaattttttttctttcgaagtgtggngtcttttatattttga

SEQ ID NO: 55500 - DNA, 417 bp, Homo sapiens
atacatttttcaggctgaaattcaaggggaatcattctgattattcttactacaaatggagatggctattatgaaacagcatgagcatgggccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttattgtaagtcattgtgtctatgatgccacttttaaaaggaaaatgc

SEQ ID NO: 55501 - DNA, 345 bp, Homo sapiens
aaacagaagcaggtgggaaaacttcccagggggcatgatgttgcagtagggttctgaagaatgagaacgcggggcccagtggctcaagcctgtaatcccatcaccttggaaggacgcgggaggattgcgtgacgcctggagttctagaccagcctgggaaacatggcaagatctccatctacaaaaaaatttaaaaatcagccaggtgtggtggtgcatgcctgtattcccagctatttgagaggctaagcaggaggactgcttgagcctaggagttcaaggttacagtgagctatgattgcaccacagtactctaccttggacaacacagcaagatcttgtctc

SEQ ID NO: 55502 - DNA, 275 bp, Homo sapiens
gagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactatgctgaaaat

SEQ ID NO: 55503 - DNA, 468 bp, Homo sapiens
gcttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttatttttgaagataatgcaggagtcatagtgaacaataaaggcgagatgaaaggttctgccattacaggaccagtagcaaaggagtgtgcagacttgtggcccccggattgcatccaatgctggcagcattgcatgattcttccagtatattt

SEQ ID NO: 55504 - DNA, 259 bp, Homo sapiens
gaagtttttgctgaattaaagtatcttcaattttaattactggatttggaagttgaaatgccatccttcaatatcactggtctcaaattcattgatagaattttttcttaaactaataagtggggtaagtataatctcctaaattggtacccactggctgctcctaaactggtttccagtcatgtcctccagtatgtgatttttataaattaaaggtaatattgtatattaaagttcaaataaagatgttctttaagtg

SEQ ID NO: 55505 - DNA, 472 bp, Homo sapiens
atagcaatttttgacaagtaagattgcaaaatagaaatatctataaagattccacagtttgacattatggcttgctatgcggatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttatttta

SEQ ID NO: 55506 - DNA, 472 bp, Homo sapiens
gtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaact

SEQ ID NO: 55507 - DNA, 133 bp, Homo sapiens
  misc_feature 12, 16, 35, 36, 52, 53, 54, 61, 86, 87, 101: n = A,T,C or G
ccccgggggggnaaanattccggggccccattttnntggggccccggggggnnntttcaangaaacttttggttccttttttccannccaaaggggaactngggggccttttttctttattcctccctttggg

SEQ ID NO: 55508 - DNA, 113 bp, Homo sapiens
aaatcccaacatataactgaactcctcacacccaattggaccaatctatcaccctatagaagaactaatgttagtataagtaacatgaaaacattctcctccgcataagccta

SEQ ID NO: 55509 - DNA, 471 bp, Homo sapiens
ggaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggatttgagtttcaacagcatctctgctgttgacaatggctctctggccaacacgcctcatctgagggagcttcacttggacaacaacaagcttaccagagtacct

SEQ ID NO: 55510 - DNA, 471 bp, Homo sapiens
gctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtgggagatgctccagctgctggtgaagatgcatgaataggtccaaccagctgtacatttggaaaaat

SEQ ID NO: 55511 - DNA, 125 bp, Homo sapiens
aatctattgggttcattattggaattaacctggtgctggatattttcaaattgtatctagtgcagctgattttaacaataactactgtgttcctggcaatagtgtgttctgattagaaatgacca

SEQ ID NO: 55512 - DNA, 472 bp, Homo sapiens
gaaaaggagctgaaggagagaggattccactgcgtgtatgttttctctttcacgtctcacttttgttctctgccatcaggaaatgcagtagacatttgtcaccagcagctctttggagacttcaatgttccttcctcccaggatccgaaaggggacttcagacaccagatgccacaggattcctacttctgaaagtttttgggccccgcaggtggaagaccggagaagccaataaagtttaaggctacattttattccatccacaaatttggtgaaggaggaaatgtttacaattctgccatgccatgaataggagttttccaccgggtgtacactgctgttaacaaggtgtaaatacttgtccagtaaagagaccgtacggtactgctgatggacgtcccaacacaatgccagatgcaaaaacttctttggtgattgcttttgataacactgagtggctaaaggtcttctt

SEQ ID NO: 55513 - DNA, 314 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagaaaagaatagagaagatagggaaattagaagataaaaacatacttttagaagaaaaaagataaatttaaacctgaaaagtaggaagcagaagaaaaaagacaagctagg

SEQ ID NO: 55514 - DNA, 427 bp, Homo sapiens
  misc_feature 18: n = A,T,C or G
aactcaaaatgtggagtnagaataacttgcgttcaaattgtgatgctatgttctcacttataagtgggagccaaatgttgagaacacatggacacatagaggagagcaacatacactggggcctataggagggaggaggataggagaagggagagattcaggaaaaataactaatgggtcctaggcttaatacctgggtgatgaaataatctgtacaagaaacccccatgacacatgtttacctatgtaacaaacctgcacatgtacccctgaacttaaaataaaagttaaaagaaaaatgtgatgctatcaaatatgaagatatagtcaacaaattatctgtgtatcagtaatcctgataattagatatgtttctatttgataattgtttgatcacaggagtagtcatattaataaacttggaaga

SEQ ID NO: 55515 - DNA, 171 bp, Homo sapiens
acttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttgagg

SEQ ID NO: 55516 - DNA, 268 bp, Homo sapiens
ggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgatt

SEQ ID NO: 55517 - DNA, 119 bp, Homo sapiens
agcacagtaaaatatatttgaaatttgataagccaaaaatgtggttttgaatgaatattttgtgaatctttcttaaaagctcaaatttgtagacttctaaatagaataaacacttgcgg

SEQ ID NO: 55518 - DNA, 454 bp, Homo sapiens
ggtttttcagctcacttcaagggtacctgaagcgaattggcaccaaagcagcagctgtattgccgcagttctagcttcaccttcacgatgtttcccttggtcaaaagcgcactaaatcgtctccaagttcgaagcatttagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttca

SEQ ID NO: 55519 - DNA, 434 bp, Homo sapiens
gggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaatgtttcatatgtgccttt

SEQ ID NO: 55520 - DNA, 392 bp, Homo sapiens
  misc_feature 35, 259, 299, 301: n = A,T,C or G
gatcctgaaatgaaaccaattttatcctcactttngagtactttagtgtagtagaggacgtatgcataaaaatgtactatggaaattcacaaaattaacggattctcaaagcagctattgaagattccacaactccagttagtccttgctggtcattaaaagggacaccagaaaaacaaataactaataaaaaatacgagttaaatggctataatgcccacctgtttggaaaaaaaaaatagggaaatagaaaatggtntatggaatcattacaaacaaattttgaaaagaactaaggngngcaaaaacattgacatataatatgtaatttagtgagacagcaactgcttcaaccgaaaagaaattgctcttcatgtaagcatgccatgtta

SEQ ID NO: 55521 - DNA, 382 bp, Homo sapiens
  misc_feature 13: n = A,T,C or G
cagccaaccaagnagcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttac

SEQ ID NO: 55522 - DNA, 433 bp, Homo sapiens
gactattattgaccccttaatttttactttataaaacatttgtatacctatataggcttatatttttgaaatatgcaaaaatttgcgttaactttttacaccataaatttaatcaatagtagcttaattagctaaattaaaattaaaaccgtttttagatcaatgtttatatctataatagagttttcagtcatagttctgtcaaagcaattttgtgttccttggacaattatagaaaacactgggtaataaaaacatattagggtaataaactctcaaagtttaacagactaatgggtagagcaaaaatatcataaaataattagaaaatatcttagtcctaatattttagccagatccttgacattattgaaattaagtctttaatagtaaccattgtactgtatatatatgtacttacacattttccatg

SEQ ID NO: 55523 - DNA, 448 bp, Homo sapiens
ccggaagtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagc

SEQ ID NO: 55524 - DNA, 467 bp, Homo sapiens
  misc_feature 11: n = A,T,C or G
agagttcaagnagtttaattgtctagtttgtgaaataatgtaacatcattttctaacagaaaagagccttagagattacagaaagacaaagaaactgaggcctgagaagagaagcaagtaatctacattcatatagtatctagagtgataaaaagtatagttctttcaatttcttggacttccccttaaaaatgactgtgtcaagggaaaaaaagggcacaatgaacccatttggttaaaaacattagctctgataaaagtcctgctaaggataaagcttagcaattcattttaataagaaacatcagacttcctacagaaggacataacccctttcttattcagtttcctcgcctgtgaacagtcataacagcacatgctctatatatctcataatatgagaaacatttattaagtgcttactacaagtaaatcataaaactatgtatattgcacctaattttaat

SEQ ID NO: 55525 - DNA, 473 bp, Homo sapiens
gagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattat

SEQ ID NO: 55526 - DNA, 441 bp, Homo sapiens
agtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttact

SEQ ID NO: 55527 - DNA, 473 bp, Homo sapiens
gcatgcctggccaatttaaaaattttttgtagagatggggtttcactgggttggtcaggctggtagcactgtatcttgaatatcattctttatcagtccataaagagcttcttaggagatagtttctttgctttcaatagttgtagaatgactcaggtggaaacttttgggaaaatgcttacattgacctacgtttaaaaatgacagtgcttcaattaattagacttattagtaggcaaaatttattgtttaaacgaaggaggtatttgattgttgtgtctaagaagtgattactggtggttttttagagccaatatgactcacaaaacatctttgatgttaagtttggaatgcctatgtcattagttctgattgggaatctgtgtaattcaaaattttagtttaaaatctgttaaggcaataaagaagccacatgctgtgtctccttggctgcagcatgttccctccattgt

SEQ ID NO: 55528 - DNA, 343 bp, Homo sapiens
ggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtattcttcctaaatagaaataaatgatcccattttttgg

SEQ ID NO: 55529 - DNA, 409 bp, Homo sapiens
gtcagaaaagaaccccttttgtcttgcaactattttttaaatccagaaatctttgtactgatgtaaatgattgtagttattttggatagtgttttgctaacaaaaggagagacttttttcatgcctatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaacctagtttctaattcccagtttctgtatagaatcgcacaagtggtttatggagtgtttggattgtaattataaatggttctttgatatgc

SEQ ID NO: 55530 - DNA, 355 bp, Homo sapiens
gtgtcagatgctggaatttattctgaccatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatattttttgtttg

SEQ ID NO: 55531 - DNA, 386 bp, Homo sapiens
aaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatggtttaggttaccaatgtattctttctcatttgggg

SEQ ID NO: 55532 - DNA, 113 bp, Homo sapiens
gaacgcgacttccacaaacctggatttttttatgtacaaccctgaccgtgaccgtttgctatattcctttttctatgaaataatgtgaatgataataaaacagctttgacttg

SEQ ID NO: 55533 - DNA, 472 bp, Homo sapiens
aggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatca

SEQ ID NO: 55534 - DNA, 288 bp, Homo sapiens
  misc_feature 274: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagt

SEQ ID NO: 55535 - DNA, 146 bp, Homo sapiens
gggcaaaaagaagaaaaagaaggattgatcagagcattgtgcaatacagtttcattaactccttccctcgctcccccaaaaatttgaatttttttttcaacactcttacacctgttatggaaaatgtcaacctttgtaagaaaacc

SEQ ID NO: 55536 - DNA, 473 bp, Homo sapiens
  misc_feature 8: n = A,T,C or G
cccgagantaaatcatctttccatccgagaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgttcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtaatattttaaatatccacagtactcacttt

SEQ ID NO: 55537 - DNA, 476 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaacccgaaggtgat

SEQ ID NO: 55538 - DNA, 422 bp, Homo sapiens
atactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttg

SEQ ID NO: 55539 - DNA, 207 bp, Homo sapiens
  misc_feature 9: n = A,T,C or G
aacaccgtnagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtg

SEQ ID NO: 55540 - DNA, 440 bp, Homo sapiens
  misc_feature 19: n = A,T,C or G
tgtttaagcatttattttnaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatcct

SEQ ID NO: 55541 - DNA, 473 bp, Homo sapiens
gagcccctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgctatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggt

SEQ ID NO: 55542 - DNA, 396 bp, Homo sapiens
  misc_feature 10: n = A,T,C or G
gaaaaaaatnacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttccaaaccctgcttttgaaatatccttgtacttaaaattcatattgctaagacactgtattaga

SEQ ID NO: 55543 - DNA, 158 bp, Homo sapiens
agtatttttatacggaaaaaattgcattgaaaacacttagtatgcagttgataagaggaatttggtataattatggggggtgattattttttatactgtatgtgccaaagctttactactgtggaaagacaactgttttaataaaagatttacattcc

SEQ ID NO: 55544 - DNA, 275 bp, Homo sapiens
aagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttggtaagaggaatttggtataattatggtgggtgattattttttatactgtatgtgccaaagctttactactgtggaaagacaactgttttaataaaagatttacattccg

SEQ ID NO: 55545 - DNA, 467 bp, Homo sapiens
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggt

SEQ ID NO: 55546 - DNA, 455 bp, Homo sapiens
  misc_feature 8: n = A,T,C or G
ccaccagnagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagccgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatacc

SEQ ID NO: 55547 - DNA, 471 bp, Homo sapiens
  misc_feature 62: n = A,T,C or G
gtgttattcatggggcagataaacaaaccctgaagagtatacaaaagaaaccatgcaaagcnccgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaatgttttatggtagctttttacttttttatgaaaaaaaattatttgccttttaaat

SEQ ID NO: 55548 - DNA, 470 bp, Homo sapiens
  misc_feature 7: n = A,T,C or G
attagtnagagaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaggaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaggaagaaactgtaaaatccaaagtgactgttgatactggagtaattcctgcctctgaagagaaagcagagactcccacagctgcagaagatgacaatgaaggagacaaaaagaagaaagattaag

SEQ ID NO: 55549 - DNA, 474 bp, Homo sapiens
  misc_feature 5: n = A,T,C or G
taatnaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtg

SEQ ID NO: 55550 - DNA, 471 bp, Homo sapiens
gggggacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttggggggagttgcccagaggaatccctgttcccactgatttttattagcaaaacatcctgtgtcttttgg

SEQ ID NO: 55551 - DNA, 420 bp, Homo sapiens
tataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatga

SEQ ID NO: 55552 - DNA, 474 bp, Homo sapiens
tacatccggttgtctaccttctaacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattccttatttcactaaatgtaaaatttg

SEQ ID NO: 55553 - DNA, 222 bp, Homo sapiens
atctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgt

SEQ ID NO: 55554 - DNA, 473 bp, Homo sapiens
ggcaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagaattggatt

SEQ ID NO: 55555 - DNA, 474 bp, Homo sapiens
gtacttggactggtgcaaacttgattccttttctccccctgtttaggagctattaaaatattactgttaaaaatccaaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatccca

SEQ ID NO: 55556 - DNA, 222 bp, Homo sapiens
  misc_feature 222: n = A,T,C or G
attcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgttn

SEQ ID NO: 55557 - DNA, 187 bp, Homo sapiens
  misc_feature 3, 7, 47, 59: n = A,T,C or G
ccngggnaattcggccttatggccggacagaactttagtattaaatngttctcaatttnttttttatgtattgttttactcctttttattcatacgtaaaattttggattaatttgtgaaaatgtaattataagctgagaccggtggctctcttcttaaaagcaccatattaaatcctggaaaacta

SEQ ID NO: 55558 - DNA, 436 bp, Homo sapiens
  misc_feature 332: n = A,T,C or G
atctaagaaagaggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgntttgaagaggccatagtacctcctgtttgaagttgtttattcacatctatcttatttgaagaaaaagactgatgtaatagatctttgtcattaaagctgaactt

SEQ ID NO: 55559 - DNA, 101 bp, Homo sapiens
  misc_feature 29: n = A,T,C or G
gaggcacgagtaattgcttgaacccaggnaggcagaagttacagtgagctgagattgtgccattgcactccagcttggacaacagagcgagaccctgtctc

SEQ ID NO: 55560 - DNA, 300 bp, Homo sapiens
atattgaaaatttataaactagaataataatgcccttaatgtgagggtttgtaatggtgcttattaagaccaaagacttgttaaatgtatacaccaagtggtaatgaaatttctgtgactggcccacacgtgcatagaggtctgggaggaccaggaaacagcctcagtggccagaggatcgccagtgcatccttcatcacagcatgtgcaatatgccaagattaccctcggtcattcctgtcaacaaggggtcaatgtcataaatgtcacaataaaacaatctcttcttttttttagttt

SEQ ID NO: 55561 - DNA, 127 bp, Homo sapiens
tacgacaaacagacctaaaatcgctcattgcatactcttcaatcagcccatagccctcgtagtaacagccattctcatccaaaccccctgaagcttcaccggcgcagtcattctcataatcgcccac

SEQ ID NO: 55562 - DNA, 474 bp, Homo sapiens
gaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaaccaaattatggggctgcttttgtcacactagcatagagaatgtgttggaaattta

SEQ ID NO: 55563 - DNA, 284 bp, Homo sapiens
gcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaat

SEQ ID NO: 55564 - DNA, 154 bp, Homo sapiens
gtgccacctggtgccgacaagaaagccgaggctggggctgggtcggcaaccgaattccagtttagaggcggatttggtcgtggacgtggtcagccacctcagtaaaattggagaggattcttttgcattgaataaacttacagccaaaaaacct

SEQ ID NO: 55565 - DNA, 271 bp, Homo sapiens
  misc_feature 249: n = A,T,C or G
gaaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaagggtattctgtaatatggaaactggggaaacatgcataagtgccaatcctttgaatgttccacgggaacactggtggacagattctagtgctgagaanaacacgtttgggttgggagagt

SEQ ID NO: 55566 - DNA, 474 bp, Homo sapiens
tgcgctctgccattcaactcggaaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagc

SEQ ID NO: 55567 - DNA, 456 bp, Homo sapiens
ggagggctgagcttgcaagaaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacagggggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattat

SEQ ID NO: 55568 - DNA, 167 bp, Homo sapiens
gaagctgttccatttcctccagtcccggcttacagcaaaagaagtgtttgataatgatggaaaacctcgtgtggatatcttaaaggcgcatcttatgaaggagggaaggctggaagaagagtgttgcattgagaataataacagagggtgcatcaattcttcgacag

SEQ ID NO: 55569 - DNA, 203 bp, Homo sapiens
tattgaaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacg

SEQ ID NO: 55570 - DNA, 392 bp, Homo sapiens
gtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagt

SEQ ID NO: 55571 - DNA, 398 bp, Homo sapiens
  misc_feature 8, 19: n = A,T,C or G
ccaagaanaggatccgagnaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 55572 - DNA, 337 bp, Homo sapiens
gatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaactt

SEQ ID NO: 55573 - DNA, 474 bp, Homo sapiens
ggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacctgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgata

SEQ ID NO: 55574 - DNA, 425 bp, Homo sapiens
  misc_feature 421: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngatt

SEQ ID NO: 55575 - DNA, 472 bp, Homo sapiens
  misc_feature 7: n = A,T,C or G
cctaacnaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtga

SEQ ID NO: 55576 - DNA, 297 bp, Homo sapiens
caaattttaaacaaaaattggggttgtgtgtggcggttcacacctgtaatcccggcactttgggaggccgagacaggcagattgcctgggcttaggagttggagaacagcctgggcaacacagtgaaaccccgcctctactaaaataattagccaggcgtggcagtgtgcaccagtaatctcagctactggggaggctgaagcaggagaattgctggaacccaggaggcggaggttgcagtggaccaagattgcgccactgcactccagcctgggcaacagagtgagactccatctc

SEQ ID NO: 55577 - DNA, 211 bp, Homo sapiens
gagaattggagaggaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 55578 - DNA, 474 bp, Homo sapiens
gatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggt

SEQ ID NO: 55579 - DNA, 468 bp, Homo sapiens
atcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcaagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcacttttaatggccaatta

SEQ ID NO: 55580 - DNA, 473 bp, Homo sapiens
  misc_feature 10, 360, 429: n = A,T,C or G
gcccaaagangcttcgaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgcgaagctcaacaaggcttcgattaacatgctgaggattgtagagccatatattgcattgggggtaccccaatctgaagtcagtaaatgaactaatctacaagccgnggttttggcaaaatcaataagaagcgaattgctttgacagataacgctttgattgctcgatctcttggnaaatacggcatcatctgcatggaggatttgattcatgagatcta

SEQ ID NO: 55581 - DNA, 228 bp, Homo sapiens
aagaaaaaaacagtataccctattcctttaaaagccaaggtaaatttgaaacctataattgataattaaaggtattcttcgtaaccctgtaacactctaataccactttgttgtcagtgtagtcagtgtaaacaagggcgtatcccgaaagcactgaggccttcctatcaaaaatccttaacccagtaacccgcagatggcccagatgcattcaatctgtagtggcag

SEQ ID NO: 55582 - DNA, 473 bp, Homo sapiens
  misc_feature 306, 337, 450, 468: n = A,T,C or G
gatatagagatttattttctgtaaattttgacgtaaatagtttgagcattaggaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggnttactgctttaccactgagctgaaatgccgngttttccatttattaaaatcacacatggctcctgtttttgtcactcagcactttttctccatattcttcaagacgattgtgagtatgggtacgtaacaggaattacatctggnaaggtgtataggttttgngtagg

SEQ ID NO: 55583 - DNA, 427 bp, Homo sapiens
  misc_feature 16, 33, 425: n = A,T,C or G
gtaataactaaacagnacatttaattttatttnaatatctatggaaaaaacacttattaaatctccctgtattttatgttgtctttattgcagaatcacttgtctgtttgttgtgtgccacttactgacaaaactttacacagtacttgatgccagctctctactctgtggctgtgggacctgtttctttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatggttttttnga

SEQ ID NO: 55584 - DNA, 472 bp, Homo sapiens
gtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttaatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagta

SEQ ID NO: 55585 - DNA, 311 bp, Homo sapiens
  misc_feature 15: n = A,T,C or G
gaataagtttatgtnacaataagttaaaagaggacagatgacagaccagtgatggtcataaattttgaagcaagtattaggataatacatttctatactgctgatgtccatgtaaaggatataatgtctggactcctaaatgcttaatgttcacagatgtgttcttgttatagtcagttttggatgctggtagatttatccttcttaattttctttcaaaagatagatatgagattaaattaacctattacaaattaaatagtaaataagcaaatagatgaatacataaagagggtcaagagggatttgtc

SEQ ID NO: 55586 - DNA, 444 bp, Homo sapiens
  misc_feature 443: n = A,T,C or G
gtccacatcatgaaagagggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaagggtatgtttccccctgtacccacttgaggcaaagataatggaaaaatgccttcaaaattctgaaggaaagttaattttaacctaaaattgtatacccaggcaaagtgctaatcaagagggcaatagaataaaaacattttcagatnt

SEQ ID NO: 55587 - DNA, 447 bp, Homo sapiens
gataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtatcatacggatgtctcactctttggagaacctaccgaattgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgaga

SEQ ID NO: 55588 - DNA, 436 bp, Homo sapiens
  misc_feature 435: n = A,T,C or G
atacctgaggttattcacccaccttggcttcccaaagtgctgggattacaggcgtgagccaccgtgcctggccaagtttaattatattttatataaatatgaaagtgcaaaaattactctactaattttggagagcatatgaagcagtgggaattttcatacactgctcctaggattataaatcagtgcaattactttgtctgagtgtgacattatttgaataagatgaaggatcacatcctaagacccaggatttgcactcatatcagaatacatatacaagtatatatcgctgagttttaatagctaaagttgagaagtctcccaaatgaccatcagtaataaaatggataaataaattatgacatacttacagaatgctatacagcaatcaaaatgaacaaactagagggacatgtttacaaagaatatatnt

SEQ ID NO: 55589 - DNA, 417 bp, Homo sapiens
gattgagctacaatgactctggagtgaagataagtttaatgcccagcagagaagtcatttaattcaggcatacttggcacattaaaaaacaacaacaacaacaaaaaaaaccacatcactttggagagtaacttggggctactgggaatgggatttcatgtatattatgatgaatttgaagcatcagtatcatgcctgacattaatacgtaagttggcttatcattttcccactacagctattagcaataaatttcttgtgaaaagtttgagtgactgtatgttgggtttggagtccaaatcatccagtatgttaaaaggcaaaattaatcaataattgtacattctgtaatgtcttttatatatgctacttaatttaaagtataaatcatcttactaaataaaatttcaaagaatg

SEQ ID NO: 55590 - DNA, 459 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaaatgtatttaaaagaaaattgagagaaaggactacagagccccgaattaataccaatagaagggcaatgcttttagattaaaatgaaaggtgacttaaacagcttaaagtttagttaaaagttgtaggtgattaaaataattttggaaggcgatcttttaaaaaga

SEQ ID NO: 55591 - DNA, 223 bp, Homo sapiens
tgcccagggcatggatggcttcagaggagtttttgaatcgaagcccagggtccttgttgatgtttcttctccgagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgc

SEQ ID NO: 55592 - DNA, 471 bp, Homo sapiens
gtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaaccttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccagggg

SEQ ID NO: 55593 - DNA, 233 bp, Homo sapiens
caccaaaagatccgcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaaga

SEQ ID NO: 55594 - DNA, 169 bp, Homo sapiens
gcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcatgcgggctatccctg

SEQ ID NO: 55595 - DNA, 259 bp, Homo sapiens
ataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgagccacctttgtggtaaacaatgaattatgaataccgcagggcagccttcttaaatgacaaatgc

SEQ ID NO: 55596 - DNA, 128 bp, Homo sapiens
gtaattgtatgtctgtgtgtgttttatgtgtcaccacctttcatgtttttgattgccctacaaagagaaaccaaatgagctgattactgactataagttctcagcctttatggacctaatcttatttt

SEQ ID NO: 55597 - DNA, 474 bp, Homo sapiens
attagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaataacaaaatgaaactgctaattagtttaaatgtaatgtttaaatgggatttgaatttcctattgcctga

SEQ ID NO: 55598 - DNA, 160 bp, Homo sapiens
atattacatttgtaaccatgatactttaatcagaagcttagccttgaaattgtgaactcttggaaatgttattaagtgaagttcgcaactaaactaaacctgtaaaattatgatgattgtattcaaaagattaatgaaaaataaacatttctgtccccct

SEQ ID NO: 55599 - DNA, 474 bp, Homo sapiens
catctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatc

SEQ ID NO: 55600 - DNA, 470 bp, Homo sapiens
gatgccaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgt

SEQ ID NO: 55601 - DNA, 474 bp, Homo sapiens
atatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccag

SEQ ID NO: 55602 - DNA, 318 bp, Homo sapiens
  misc_feature 21: n = A,T,C or G
aatatagctttgacataaagnagaagaaatctaataatttttttaatgtgataaaaaccaagatcatagtgggagattttagcacacatctttcagaagttgacagaacaaagtagaaaaaaaataaatacatatatttatgtaacatgagcagttaatgagcttaatgtaattgatatgtagagataaacattcagtatacaagaaacagtcacaaaaattgatcaaatattaaaacacaaggaaatgtaaacaaatattaaaagaaaattatagacgccatgttcacagaccacagaaggtaaaactggatatttg

SEQ ID NO: 55603 - DNA, 472 bp, Homo sapiens
gggcgcctgcgccctctcctataaagcgacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacacttttttgaactcattctggctgcaaactac

SEQ ID NO: 55604 - DNA, 474 bp, Homo sapiens
  misc_feature 11: n = A,T,C or G
atttaaatgtnatcgagaaggcagagacttcccttggaatccctggtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtga

SEQ ID NO: 55605 - DNA, 157 bp, Homo sapiens
acaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctc

SEQ ID NO: 55606 - DNA, 315 bp, Homo sapiens
  misc_feature 11: n = A,T,C or G
attgacatggnatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgatgacttgttgccctgaagtacaataaaaaaaattcattttgctccagt

SEQ ID NO: 55607 - DNA, 317 bp, Homo sapiens
atatgtatgtatgtgtggtgaatatatttctttttgttcggagcaaagattttttcaatatgtatatttattttaggcagattatgctagtaattttctacaaatgtgctttttaaaaaataacctttaatttaaaaaaattattcttactcagtggcccacaattgttaaaaacgctactaatggagctgggtatggtgacacacacctgtcatcccagctacttgggagactgaggcaggggtattgcttaaacttgggaatgtgaaaccagcctgggcaacatagtgagatcccaatctcaaaaatcaatccca

SEQ ID NO: 55608 - DNA, 465 bp, Homo sapiens
  misc_feature 135, 165, 224, 230, 265, 280, 422, 425, 455: n = A,T,C or G
gggggggctcataaaactcctctctctttctttctttcttttcctctttcctctgtttaattaatgtaggttcgcattggcctctaataagggaaagaagaacagcagaagcaaatgataaatcttagtaggagngtagaccagctagttttactagtatcttgnggtagtaattcaaaggtaactggaaaaataaaactgagctcaagtcttgagtattttgngctggngggaaatggaacattcaagaataaagaaacaaggngaagaattggtcagnggtaacatttattgggaggaaattgactgaattttggcaataaaccagcagaggaagttgacctaaagaacagactgtcagtcatctgtttctttggcattatttatacaggtcctttcctcattctctctttttatgctgnttnattaggtcctgctgttgtattaggtcttgnttttttctta

SEQ ID NO: 55609 - DNA, 205 bp, Homo sapiens
agttcaagaccagcctggccaacatggtaaaaccctgtctctactaaaaatacaaaaaattagctgggcatggtggcacatgcctatagtcccagctactcgggaggctgaggtgggagaatcacttgaacccaagagacagtggttgcagtgagccgagatcatgccacctttctccggcctgggcagtagagcaagactacgt

SEQ ID NO: 55610 - DNA, 342 bp, Homo sapiens
gggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagatt

SEQ ID NO: 55611 - DNA, 105 bp, Homo sapiens
gatgcggtggtgcgtgtgatttgtcaaaagaaagccttctggatgctgttaagatgtacccttcaggtgaacctggtatcagacccacagtacttgctgtttgag

SEQ ID NO: 55612 - DNA, 269 bp, Homo sapiens
gattactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttcg

SEQ ID NO: 55613 - DNA, 440 bp, Homo sapiens
gggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtc

SEQ ID NO: 55614 - DNA, 476 bp, Homo sapiens
gacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgt

SEQ ID NO: 55615 - DNA, 472 bp, Homo sapiens
gagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatata

SEQ ID NO: 55616 - DNA, 471 bp, Homo sapiens
tgtaaagaaacagcttcttcattcctgcactggttgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgttgaaattcggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagta

SEQ ID NO: 55617 - DNA, 208 bp, Homo sapiens
  misc_feature 25: n = A,T,C or G
taattctaacttatacaagtatgtnattgaagtccaagtagctgaatttctagaacttgtgctttctttctttcagcattgctggcccaactttagatactggcatttaaaaatgattctttgaaacagagacggttacagggaaaaactgttaaacatagttttggatcattggtcccctttcattaaatcctaggcacagctacct

SEQ ID NO: 55618 - DNA, 110 bp, Homo sapiens
agaacagatgatctccatttccgccagctgcctgtagccacgtggcatcctgcctgtggtctgggtgagatttactgtgaccagatgtagaataaatgtgtctcatcctg

SEQ ID NO: 55619 - DNA, 474 bp, Homo sapiens
  misc_feature 40: n = A,T,C or G
gcccataggaagcctctctccctactgctgctacacaagnaccctgagactgacctgcaggacgaaaccatgaagagcctgatccttcttgccatcctggccgccttagcggtagtaactttgtgttatggatcacatgaaagcatggaatcttatgaacttaatcccttcattaacaggagaaatgcaaataccttcatatcccctcagcagagatggagagctaaagtccaagagaggatccgagaacgctctaaacctgtccacgagctcaatagggaagcctgtgatgactacagactttgcgaacgctacgccatggtttatggatacaatgctgcctataatcgctacttcaggaagcgccgaggagccaaatgagactgagggaagaaaaaaaatctctttttttctggaggctggcacctgattttgtatccccctgtagcagcattactgaaatacataggctta

SEQ ID NO: 55620 - DNA, 233 bp, Homo sapiens
  misc_feature 5, 9: n = A,T,C or G
acccngggnaattcggccttatggccgagggagaccagcctgtctaacatggtgaaaccccatctctcccaaaaatataaaaaattagccgggtgcggtggtgcatgcctgtaatcccagctactcaagaggctgaggcaggagaatcacttgaacccgggaggtgaaagttgaagtgagccgagatcgtgccactacactccagcctggatgacagaatgagactctgtctc

SEQ ID NO: 55621 - DNA, 473 bp, Homo sapiens
  misc_feature 13: n = A,T,C or G
gcaaatgacaagncgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttattttta

SEQ ID NO: 55622 - DNA, 241 bp, Homo sapiens
gagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactac

SEQ ID NO: 55623 - DNA, 472 bp, Homo sapiens
gaataagaagccggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaagtgtagtg

SEQ ID NO: 55624 - DNA, 469 bp, Homo sapiens
agaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaaccc

SEQ ID NO: 55625 - DNA, 238 bp, Homo sapiens
aagaaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgat

SEQ ID NO: 55626 - DNA, 227 bp, Homo sapiens
gggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgc

SEQ ID NO: 55627 - DNA, 143 bp, Homo sapiens
  misc_feature 6, 14: n = A,T,C or G
gacccngggtaatntcggccattatggcggggaatccccatcattactggtaaagcctcatttgaatgtgtgaattcaatacaggctatgtaaaatttttactaatgtcattattttgaaaaaataaatttaaaaatacattc

SEQ ID NO: 55628 - DNA, 477 bp, Homo sapiens
gcaataaagtttttggtgccctgaagggagctgtggatggaggcttgtctatccctcacagtaccaaacgattccctggttatgattctgaaagcaaggaatttaatgcagaagtacatcggaagcacatcatgggccaggaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaaccttat

SEQ ID NO: 55629 - DNA, 145 bp, Homo sapiens
tgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 55630 - DNA, 465 bp, Homo sapiens
  misc_feature 422, 441, 445, 463: n = A,T,C or G
tcataaatgagggctgcacattgcctgttctgcttcgaagtattcaataccgctcagtattttaaatgaagtgattctaagatttggtttgggatcaataggaaagcatatgcggccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggngattatttttttatactgnatgngccaaagcttactactgngg

SEQ ID NO: 55631 - DNA, 469 bp, Homo sapiens
  misc_feature 36, 462: n = A,T,C or G
gaactaagaagtcagactgtccttgacccctagatnaaatgtttttgagcctgagtttccttaaatcttcttcagttgagaataaacattttgacaaaatagaagatttattctgttaatttttggtcttcataaacctaactaaatttgctaaaacaacaaaaactttctaatttttactagttttgttttttaaaaagtttgtttccttttaagtgcataacactttaaaatgagctcagctgtattagcagataaacatgttgattcatttggtccagagctactgaatgaagcttgcaggagcacagtttgttctttatgccgcccagggcagaatgtttctcttcctctcctccttattgagagaaggggactggaataagtgactcctcttatttaggtttgcctgaattgttgacgagggaagggggcaagatttcttcaccatttatccttcgnctcattt

SEQ ID NO: 55632 - DNA, 342 bp, Homo sapiens
gctttccggcggtgacgacctacgcacacgagaacatgtctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 55633 - DNA, 186 bp, Homo sapiens
  misc_feature 4, 5, 81, 100, 102, 103, 108, 149, 150: n = A,T,C or G
cggnntttatggcggggaccgtatttcagcctgataagaacagagtgcctgccttcccaggaaaatacgaaaatcccatgngataaataaaaatataggngnngggcngatcttttctttaaaataaaaaaagcaaaaactcttgtggnncctagtcagatggtagacgagctgtctgctgccgcg

SEQ ID NO: 55634 - DNA, 393 bp, Homo sapiens
  misc_feature 10, 253, 261: n = A,T,C or G
ctactgagantatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtcttttttnctttggtnaaaaaaatttggatgttctttaaaatcgttaatgtataacagggcttatgttttcagtttgttttccgttctgttttaaacagaaaataaaaggaggtgtaagcctccttttctcattttcaaagttggcta

SEQ ID NO: 55635 - DNA, 191 bp, Homo sapiens
aactatataaatatctaacagaattagtggaacagaaaacatgcaagaaatagtgtagatttttcaagcgaaatatctgaaagaattcataaacctgggtactctctaccaagattaacacaagcaaagggaaagaatgcacaattaataagttattccagaatgcaaaaggagactgaagttatacaacc

SEQ ID NO: 55636 - DNA, 469 bp, Homo sapiens
aacatacaagaatctctgggacacatttaaagcagtgtgtagagtgaaatttatagcactaaatgcccacaagagaaagcaggaaagatctaaaattgatagcctaacatcacaattaaaagaactggagaaacaagagcaaacacattcaaaagctagcagaaggcaagaaataactaagatcagagcagaactgaaggaggtagagacaaaagaaacccttcaaaaaaatcaatgaatccaggagctggttttttgaaaagatcagcaaaatcgatagactgctaccaagaccaataaagaagaaaagagagaagaatcaaatagatgcaataaaaattgataaaggggatatcaccaccgatcccacagaaatacaaactaccatcagagaatactataaacacctctatgcaaataaactagaaaatctagaagaaatggataaactcctggacacatacaccct

SEQ ID NO: 55637 - DNA, 438 bp, Homo sapiens
  misc_feature 17: n = A,T,C or G
atgaaagaagatacagnaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcggagatgagctttaaaaacttgaaaaacagtttg

SEQ ID NO: 55638 - DNA, 192 bp, Homo sapiens
gcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgatttttttttttt

SEQ ID NO: 55639 - DNA, 304 bp, Homo sapiens
atttgtaggaatagaaaatagagatgtggaaagggtaagaaaagaaggtacctaggagatgaagatgttactgagtctggggtgcagaggagaggtctgatcttgaaatacgattttcagaacaattcaagaacatagagctgataattgaaagcgtgcatactgggagtgagtgcccagaaaatggaattcctgctttctaggaaacgttgtgagggttagcaaggaaagagatacaaaatttagtgaaaatttagagtcatgttaaaaagtgtttgggaaggggagagaattgaaaataatc

SEQ ID NO: 55640 - DNA, 473 bp, Homo sapiens
atagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatgggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaaacttttctagaatt

SEQ ID NO: 55641 - DNA, 216 bp, Homo sapiens
  misc_feature 7, 17: n = A,T,C or G
ctttgangctaaaggtntagtaacccctaaaagaaccctactaacttgattgttgtgaactggggtgaatttgttaaaaatgagtaactttgataaagtttttcatgcacaggcagaatgtattcactagatttctacgtagtgatctgcttttactttgtaatttgtagttctcaaaagacttttttttaaaaaaataaagtccatacttaccct

SEQ ID NO: 55642 - DNA, 450 bp, Homo sapiens
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcggatcgtaatgaggcgtgcgccgccaatatgcactgtacattccacaagcattgccttcttattttacttcttttagctgtttaactttgtaagatgcaaaagaggttggatcaagtttaaatgactgtgctgccccctttcacatcaaagaactactgacaacgaaggccgcgcctgcctttcccatctgtctatctatctggctggcagggaaggaaagaacttgcatgttggtgaaggaaag

SEQ ID NO: 55643 - DNA, 349 bp, Homo sapiens
ggatatgaattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatattagatacatatattgaaagaaggcttttattgaacagcttatcttccact

SEQ ID NO: 55644 - DNA, 474 bp, Homo sapiens
  misc_feature 5, 7: n = A,T,C or G
aagantnagaaacccagaccaacctcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagc

SEQ ID NO: 55645 - DNA, 264 bp, Homo sapiens
gtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaaga

SEQ ID NO: 55646 - DNA, 102 bp, Homo sapiens
  misc_feature 84: n = A,T,C or G
cttgggcaagcagaaaaattaaattgtacctattttgtatatgtgagatgtttaaataaattgtgaaaaaaatgaaataaagcntgtttggttttccaaaag

SEQ ID NO: 55647 - DNA, 472 bp, Homo sapiens
gtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctga

SEQ ID NO: 55648 - DNA, 473 bp, Homo sapiens
gaatcagcaagctgaagaacttcggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccacgtgaattctcttgcacaagatgaaactaaactgaaagctcatcttgaaaagctagaggttgacttgaataagtctctgaaggaaaatacttttcttcaagagcagcctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaac

SEQ ID NO: 55649 - DNA, 470 bp, Homo sapiens
  misc_feature 401: n = A,T,C or G
gacacaacctaggtgttcatcaatgggcaaatggataaagaaactgtgatatagagagatcaatagatagataattagaatattatttagcctttaaaaagaaggcagtcctgtcatttgccaaaacatggatagacctagaagacattatgctaaatgaaataagccagacacagaaagaaaaatattgcgtgatctcacttatatgtggaatcaagaaaaaaaaggttaaatatatagagatagagaataaaacagtaattactaaggtcaggataaggtggaggaaatgagatgtaggtcaaaggatgcaaagtagtaaatatgcaggatgaacaagtgaaaagatcaaagatcaaatgtacaacatgaggactatagttaatacatattgtatattngtgttcaggactttttgctaaatgagtagattatacctgctcttgccaatgggggaataatcagtaact

SEQ ID NO: 55650 - DNA, 436 bp, Homo sapiens
  misc_feature 348, 351: n = A,T,C or G
attttattactgtttattacttcctgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggnggnagatattgaggccaagaatattgcaaaatacatgaagcttcatgcacttaaagaagtatttttagaataagaatttgcatactta

SEQ ID NO: 55651 - DNA, 376 bp, Homo sapiens
  misc_feature 6: n = A,T,C or G
cacagnatgagagcggagtatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcat

SEQ ID NO: 55652 - DNA, 169 bp, Homo sapiens
gaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcc

SEQ ID NO: 55653 - DNA, 381 bp, Homo sapiens
gaggcgagtagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggagg

SEQ ID NO: 55654 - DNA, 351 bp, Homo sapiens
  misc_feature 15, 18, 59: n = A,T,C or G
tgcggggtaatttcngcnttatggtcgcggggaatcttgtagatgagtaattttacagnaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagacgag

SEQ ID NO: 55655 - DNA, 411 bp, Homo sapiens
caagaaggcagtcacacttacgtttttatgtatttgttgaagagtcccaatgtatttaaagcaaaaataagcaactacaaagagaaagatacaaatccatgatcaaagtgaggaattttcacacacatcgtagtaactgatggaatgagtcaatgaaaaattagtgaggaaatagaagatttggacggcacaacaaatggcctaggagaacatttagaatgttgccttcgatgcttaagaatacatattcttttcaaaagaaaacacagaacagcctggcaggagagataccatcatcatgaaggtgattttcccagagctgggcttatccattgcattctggatgtgctgacgcctgtggttttcccaaatgtgggaaactggactgcataatttgtggggagggggggg

SEQ ID NO: 55656 - DNA, 468 bp, Homo sapiens
  misc_feature 327, 440: n = A,T,C or G
gcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgnggcttttgaatatcttccacagagggaagtttaaaacccaaacttccaaaggtttaaactacctcaaaacactttcccatgagtgtgatccacattgttaggtgctgacctanacagagatgaactgaggtccttgttttg

SEQ ID NO: 55657 - DNA, 451 bp, Homo sapiens
aaccagaactgttggtagctgtttaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagatttagatgttagctgctgaagtttgtgggaggtcggacataaagcttccaacatcagtaatgcaaaattgtcttgaacctgcgataaaattttgttggactttttttttcattgcagtgaaaagggccatgtagcatgcctcaaagccaggttactcagcctagtccttgtttaagcagttttgatatt

SEQ ID NO: 55658 - DNA, 366 bp, Homo sapiens
gggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgcaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaaga

SEQ ID NO: 55659 - DNA, 320 bp, Homo sapiens
gcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatg

SEQ ID NO: 55660 - DNA, 415 bp, Homo sapiens
  misc_feature 13: n = A,T,C or G
gtctgccaagaanaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcattagtggttccggctgccctttctaggtgattggaatcagcccatctaaagcagtctttatatgcattccgaggccagagtaacattttgaact

SEQ ID NO: 55661 - DNA, 470 bp, Homo sapiens
aagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgttgtctggggcagaccgaccaccttctatctttgagtgccagctacatctttgggatcagtggtttcgaggctgggctgagcaggagtgcaatgaatttgtcagacagctggagttcagtgagccagacttcgt

SEQ ID NO: 55662 - DNA, 392 bp, Homo sapiens
attgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtgggaaagtcacccaaacacttctgctttcacttaagtgtctggcccgcaatactgtaggaacaagcatgatcttgttgctgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgataagagggaatttggtat

SEQ ID NO: 55663 - DNA, 420 bp, Homo sapiens
ggcctttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcatttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtga

SEQ ID NO: 55664 - DNA, 146 bp, Homo sapiens
atcagtgacactgataaagtattttttcatattttagttctcatgtttttgactctttattttaactttgttgttgattgaattgagtatttgagttgctgttagtataaataaagtttccatcttggatgacttaccatgttaac

SEQ ID NO: 55665 - DNA, 175 bp, Homo sapiens
actcgagcctaggagttcaaggctgcagtgagccatgatgtcgacactgcattccagtactgggggaaagaggatagaatttaactgactgataccaagagatgttcacaacatattattaaatgaaaaaattcaaattacaaagctatgggcagtatgatcccattgttttaag

SEQ ID NO: 55666 - DNA, 231 bp, Homo sapiens
  misc_feature 5, 23: n = A,T,C or G
tggcncggggtgctgtgaaaaantctgatgactttaattaaaatcttgtgaccttttgcttctactaaaagttatctactctttagttgaatattttcttttggagagattgtatattttaaaatactgtttagagtttatgagcatatattgcatttaaagaaagataaagcttctgaaatactactgcaattgcttcccttcttaaacagtataataaatgcttagttg

SEQ ID NO: 55667 - DNA, 315 bp, Homo sapiens
aatgtgtttcataagaaagtcctactcaccatgaagtcacttaattcagaaattacagagaacaataaaaaccaagctgattgttggcaaacttgaatgaaaaatttatacctggaggttttcctttctaataggcaaccatatattttatggagctgaaacttttaggtttgctgcttttgtcgttgtcttcaccatttctcctttccttaaaagaaacaatagttttatatattaattttgatgtgctaagtatgtacaacttaattttttaaagaacgtttttcagatatatacatgtatataaattcatgc

SEQ ID NO: 55668 - DNA, 428 bp, Homo sapiens
aagtgattctcctgcctcagcctcccaagtagctgaaactacaggcgcatgccaccatgcccagctaatttttgtatttttagtagagacagggtttcactatgttggccaggctggtctcaaactcccgacctcaagtgatccgcccgcttcggcctcccaaagtgctgggattacaggtgtgagccactgcgcctggctgctgatttatttttcatagacacgggggtctatgttgcccaggttggtcttgaactcctagcctcaagcgatcctcctgcctcagcctcccaatgtgctgggattacaggaatgagccaccatgcccagcccaagaagtagagtttcttttatactgactttggcctaaaaaaacagattttcatggaggaaaaaaaaaacctagatttttaataagactattttat

SEQ ID NO: 55669 - DNA, 449 bp, Homo sapiens
cagtggtttattgttccaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatacaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtaattttgggctttgggctgcaatttgttttatgcttattttattaattactg

SEQ ID NO: 55670 - DNA, 455 bp, Homo sapiens
cacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgttttggatggcaatcgcatctcagaaaccagtcttccaccggatatgtattgaatgtctacgtgttgctaacgaagtcactcttaattaatatctgtatcctggaacaatattttatgggggtatggtttttctgtggggtcagttttcatagtatccatattttattactggttattacttccatgaattttaaaatctgagggaaatgttttgtaaacatttattttttttaaag

SEQ ID NO: 55671 - DNA, 418 bp, Homo sapiens
  misc_feature 3: n = A,T,C or G
acnaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaagtggcaccgtcatgggtgctgaaatccggcatgttcttgtcacactgggtgagaagatgacagaggaagaagtagagatgctggtggcagggcatgaggacagcaatggttgtatcaactatgaagcgtttctgaggcatatcctgtcggggtgacgggcccatggggccggagctcgtccgcatggtgcttgaatggctgaggaccttcccagtctccccagagtccgtgcctttccctgtgtga

SEQ ID NO: 55672 - DNA, 205 bp, Homo sapiens
gggaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtt

SEQ ID NO: 55673 - DNA, 184 bp, Homo sapiens
  misc_feature 182: n = A,T,C or G
gcccgagtagaagataacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagangc

SEQ ID NO: 55674 - DNA, 442 bp, Homo sapiens
  misc_feature 85: n = A,T,C or G
gctttttccaacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtgggatgagaactaatcgctgatcgtcagatcaaataaagttataaaattgc

SEQ ID NO: 55675 - DNA, 469 bp, Homo sapiens
actgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccacc

SEQ ID NO: 55676 - DNA, 469 bp, Homo sapiens
  misc_feature 462, 463: n = A,T,C or G
gcaagaactcattaataccaagcccaagaaggaactgctgatcatcagggatctgatcacaaaataaattagcagttttgcatcacgatgtcttgtgacatacatgcattagtgaaagtaaataagcatgaagacagactgattaagctcactcatataattggtttttgagaacggttccaatatattgggagaaaaataagcatcaacttggaaatcaaattgacttttttcttaacactgaacaaaagaattgttagaggtttgaggtaaaagatcgtggcagaagccagtattgattcacattactggtcagccctcttaagattctatgcttctctgggtgttaaaagtccactggaaaataagagaaagaaaattgagtttcaagggacgtagaaaaatctgatttgaaatcaggtggggaaagtgctctaatgccactagtattagggaggcggnnaatttg

SEQ ID NO: 55677 - DNA, 477 bp, Homo sapiens
  misc_feature 427: n = A,T,C or G
gttgcaagccacaaaaagttcaaggatctagaagacgattaagggaaagtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtntgtatggttattggatacattaaaaatgcacgcaagccattatctctcca

SEQ ID NO: 55678 - DNA, 473 bp, Homo sapiens
cacatgggagatccaggatcaacaagaggcagaggaaaagggaaaattgtgaacaagagccttaactgtaatttttgtgaaaggaataagtgagtcagggtaagcagatgtaggattggctactttgaataattttagtgggctttggagcataggggaagtccctagttgtatggtacctggccttaggcaattaaggtaggtggatagtggcccagagtgtgagagctggttaaagaagatggttgaggttaaaagctctggattgggtgattagcatttgaaagaaatcctcatgggctggtggtttactatatctaagaattgactaactctaaaagggtcagttcctccagcatcatcagggcccaagacactaaaacatcagaatatagaaaataaaagacatggttaatacaaggtggatatctactttacacggtctacaaaaatcaacccagaatagagcaaag

SEQ ID NO: 55679 - DNA, 474 bp, Homo sapiens
ggaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtgattaaaag

SEQ ID NO: 55680 - DNA, 401 bp, Homo sapiens
aagaagaggagtcctttaggaagcttcacttaaaggacaagaagcgatttgaaaaagctaaccaggattcaggtcccggtttgagtcttgaagaatttattgcttttgagcatcctgaagaagttgattatatgacggagtttgtcattcaagaagctttagaagaacatgacaaaaatggtgatggatttgttagtttggaagaatttcttggtgattacaggtgggatccaactgcaaatgaagacccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatg

SEQ ID NO: 55681 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaggg

SEQ ID NO: 55682 - DNA, 167 bp, Homo sapiens
gttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcc

SEQ ID NO: 55683 - DNA, 440 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 55684 - DNA, 451 bp, Homo sapiens
gaactcttctggcatttaaaaacaattactcagttcagcagagaagtcactgacaaacgagatcacactgactgctttgtcgttttggttttgtcttactcattaatgcaaataagaacattcactagcatctgtgtcgggcctaccctccctggtcaaatacagctacagtctccctgcagatacgagttttccagaaatgagccgatgttttctgcgagaatcaattggtcatatacaatttacaaaaatgagtactgtatactatatttgtaaactgtacactgcagatgctttatttcactgaaatttataatacacttatccatgtatatgcatgcatgcatttttgttcctgagatccagctgtgaaatgtttaccagcacataaattaccagcacatgctcttttttgttaacctactaggtaaaatcttcatttattacatcg

SEQ ID NO: 55685 - DNA, 474 bp, Homo sapiens
gatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactatttgatttcccatggtatgaatataactattggtaattcttcaaatgagac

SEQ ID NO: 55686 - DNA, 363 bp, Homo sapiens
ctgaataatggaaattgtattttttggtttagccagtttgtttttatctttcttgatctctttctcaaagcaatttctgtttgagttagtggctttaaccacttatccctaggtatatatcaagattagtaaactatggaccaccagccaaatctggccccttagagacagaggttctcaaccctggtctatattcatgattttgggggtttattgtaccttatgtacttattgtaaataaatataaattctttctgaaagtaggtaggagtagaactctaaatatacatccatcaacatatccaagttggtcagactgaaaattgaaaattacccctttttggtgtgttatgacgatttgtt

SEQ ID NO: 55687 - DNA, 403 bp, Homo sapiens
  misc_feature 396: n = A,T,C or G
aaccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattattgggggggggattatttttttatactgnatgtgct

SEQ ID NO: 55688 - DNA, 463 bp, Homo sapiens
gccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtgga

SEQ ID NO: 55689 - DNA, 332 bp, Homo sapiens
ggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtgggattttgtgctcttgt

SEQ ID NO: 55690 - DNA, 229 bp, Homo sapiens
ggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttc

SEQ ID NO: 55691 - DNA, 458 bp, Homo sapiens
gggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaattgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacgg

SEQ ID NO: 55692 - DNA, 278 bp, Homo sapiens
actttaaaagaatgagatgagcatagcattgaacgaggtatcccatttcagtggtaattatttcccttgagtaaattaaatagtcttttatttaggggaaaataaaacagtaaaaaatatcaagttttatcatggccaagttttatcatggtcaaaatagtagtggtgagattatctgtactacagttttaatttaaagtaaatcttttaagcaaacatgtatggaaatattaagtcattttccagattttgacttgctcagtatgaccattataaat

SEQ ID NO: 55693 - DNA, 220 bp, Homo sapiens
aaccatgacttgcccacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgtc

SEQ ID NO: 55694 - DNA, 142 bp, Homo sapiens
gggctggggttggagggtcccacccaccaccctgctgtgcttgggaacccccactccccactccccacatcccaacatcctggtgtctgtccccagtggggttggcgtgcatgtgtacatatgtatttgtgacttttctttc

SEQ ID NO: 55695 - DNA, 359 bp, Homo sapiens
caactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttgg

SEQ ID NO: 55696 - DNA, 311 bp, Homo sapiens
cagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcaagct

SEQ ID NO: 55697 - DNA, 338 bp, Homo sapiens
gcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaac

SEQ ID NO: 55698 - DNA, 472 bp, Homo sapiens
  misc_feature 6: n = A,T,C or G
cgaaangagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaacctacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagatttttaagaccgttgaaatcaattatcaagaacgtcctaaaacac

SEQ ID NO: 55699 - DNA, 474 bp, Homo sapiens
  misc_feature 17: n = A,T,C or G
tgaggaaaattaatatnacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttggtagttgttaagttgccctgctacctagtttgttagtgcatttgagcacacattttaattttcctctaattaaaatgtgcagtattttcagtgtcaaatatatttaactat

SEQ ID NO: 55700 - DNA, 473 bp, Homo sapiens
  misc_feature 254, 306: n = A,T,C or G
atcgagaggacagttagactattccggagaagattgggcctgaattagtgtcaattatataggaaactaaccttgggaatagcaacacagtatttccaggaaaaaaaaaatgttttaaataggggaaaacttatggcttagctgagaatatttttataggcatagtaaactaaacattgattattgttctatccaaaaggaagacttcactatgtagaaagaattgagaatgacactagttaaatatttatgcnttactgggttcaagatgattgaaagataattaaattctcttctttcatagtnggagatttatagccaataactgtgaagaatcacaaagtagcacttattagaataagtgactatcaaacaaacgttagaaagtgcttctggctgggcatgggggctcatgcctgtaatcctaacactttgggaagccaagatagggaggattgctttgagcccaggca

SEQ ID NO: 55701 - DNA, 472 bp, Homo sapiens
  misc_feature 27, 407, 417: n = A,T,C or G
gagaggcgtcagtggattggccacgtnatgtaaagttgacccgagagggagggcaaaagaggaaggcttggtgattcctggctaaggtgattcaaactaaatcaacccaatgtctcacctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttggngggaacaagnagatgaccttgaggataaaaggaccaaagaaaaagctttacttagatgattgatt

SEQ ID NO: 55702 - DNA, 416 bp, Homo sapiens
gattaaaagaaccttgaaatcctgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagataggaacaagatagaaaatgaaaatatcgtcaagagtttcagatagaaaatgaaaaacaagctaagacaagtattgg

SEQ ID NO: 55703 - DNA, 423 bp, Homo sapiens
  misc_feature 195, 209, 347, 406: n = A,T,C or G
ggcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagnggaaaacaagtggncgttactagctaagatgtgtttgacttttggatctgcatttgctacacccttccttgtagtaagacaccaactgcttaaaacataaggatgtttcagttcctccatttaacagatatgaagagcatttttaagaaggngcagcctctgggaagtggatcaaaactagaactcatatgccatactagattttgtttgncaataaaccttatgacg

SEQ ID NO: 55704 - DNA, 309 bp, Homo sapiens
  misc_feature 6, 8, 22, 24, 69, 80, 211: n = A,T,C or G
gtaatncngccttatggcgggnangttgaggtttttatgctgaaggttaaagggcaagtgtttggtatngaagagcagtntgtgttaagaaaagaaaaatattggttcgcgtagagtgcaaattagaactagaaagttttatacgattatcattttgagatgtgttaaagtaggttttcactgtaaaatgtattagtgtttctgcattgcnatagggcctggttaaaactttctcttaggtttcaggaagactgtcacatacagtaagcttttttccttctgacttataatagaaaatgttttgaagga

SEQ ID NO: 55705 - DNA, 395 bp, Homo sapiens
  misc_feature 2, 22, 43, 372: n = A,T,C or G
antccggaggtaatttctgacnttatggtcgcggggcactgcnataggtaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaanaatacgcggtctcctgagaactt

SEQ ID NO: 55706 - DNA, 141 bp, Homo sapiens
gctgtacggtagagttatacttatttctgtgatccagttcatttgtttaatattgggattcaaggagtgttgaagaaatgtctactgattaataacagatgggaagagtgtatgtgttttaaataggagaccaagagagac

SEQ ID NO: 55707 - DNA, 473 bp, Homo sapiens
  misc_feature 465: n = A,T,C or G
gaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttggaagaattcaatagtctttcaagatgtttaatgtggtttaaagctgggaacctgttngggagttc

SEQ ID NO: 55708 - DNA, 471 bp, Homo sapiens
atatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaata

SEQ ID NO: 55709 - DNA, 487 bp, Homo sapiens
ccttatggccggggaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatggtatattgcatacacataaattcaaactata

SEQ ID NO: 55710 - DNA, 473 bp, Homo sapiens
gggaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtt

SEQ ID NO: 55711 - DNA, 191 bp, Homo sapiens
gaaaaggagcttgtgcaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 55712 - DNA, 472 bp, Homo sapiens
ggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaaggttagtggtacagctaaatattaaagaataaaaaagttgaatttacagccttaatctttacaagtaaagttactgtttaattaaagttaaacctttatcttataggatacctgtattaactgtcttttgtttgcctttcagcggttgttgacttgaatgggaggtatttttggtggacgggtggtaaaagcatgtttctacaatttggacaaattcagggtcttggatttggcagaacaagtttgattttaagaactagagcacgagtcatctccggtgatccttaaatgaactgcaggctgagaaaag

SEQ ID NO: 55713 - DNA, 270 bp, Homo sapiens
  misc_feature 269: n = A,T,C or G
gatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccnc

SEQ ID NO: 55714 - DNA, 474 bp, Homo sapiens
  misc_feature 35: n = A,T,C or G
gtctataagccattattaaaaaatacaccaaaatnattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacaca

SEQ ID NO: 55715 - DNA, 473 bp, Homo sapiens
atgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaactttgttctttatcagcctcatgcctgaatcaaatttttaattattctgaaactgctgctgtttaaagtggaatcttttagtattat

SEQ ID NO: 55716 - DNA, 210 bp, Homo sapiens
  misc_feature 6, 11, 13, 14, 24, 25, 27, 28, 29, 34: n = A,T,C or G
ctgttnctgcntnngctataatgnntnnngaatnctttgaaggcttcccagataagcagcccaggaagaaatgaaaactcctctgatgtggttggggggtctgccagctggggccctccctgtcgccagtgggcactttttttttccaccctggctccttcagacacgtgcttgatgctgagcaagttcaataaagattcttggaagttt

SEQ ID NO: 55717 - DNA, 227 bp, Homo sapiens
  misc_feature 20, 22: n = A,T,C or G
gagtgccgtggtactgagantngtggtgagaaacctggaggaagcgcttttaagtggcatcctactcagttgtttttaaagcgttagattcagcattcactgtaaggagcaattaaaaacccctttaagatatgttattatcaagccctctctcttgtatggaagataatgacaggagaccagaaaagggggagggggctgctaatgtgttaactagactttgacga

SEQ ID NO: 55718 - DNA, 319 bp, Homo sapiens
  misc_feature 21: n = A,T,C or G
cattatgatttcattatcacntgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttc

SEQ ID NO: 55719 - DNA, 473 bp, Homo sapiens
  misc_feature 13: n = A,T,C or G
gggcactattatnaaaagtaaaatatgactcaagtgcgagtggtcaatcatcttttgtgacatccccagcagcggacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaac

SEQ ID NO: 55720 - DNA, 482 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaacccgaaggtgattaaaaga

SEQ ID NO: 55721 - DNA, 316 bp, Homo sapiens
  misc_feature 25: n = A,T,C or G
tatggccggggtgacagagtagagnacagttagtgaggagggacagacagctcttcctttcggagcctggctagtctaggacatcacctcgctgtgtcttctcaagcttttaaaattgaccctgaacgtgtgacagggtcctatggtgttactcaaagctgtgcagggtagatgatgacatatttattctttttccatttgttctagaaacagtgcctttttcatcagttgcattttccaggctgagagctgtataaaacattttggactgtgaccatgtaccttcctttttaagaaaaataaactgctttatggt

SEQ ID NO: 55722 - DNA, 480 bp, Homo sapiens
  misc_feature 15, 426: n = A,T,C or G
tatggccgggaagtnaaagttatgtaggtcccccaaacaagctgttgtacattcagaatagaatgtttcctatttcatgtcaaaagtgcagatttgcttcctgataagatgtactatttggagactgtctattttttattgtgattcagatgcaaataacaggaaaacatatttttttcctatcttggcaaaagaagtatttctaaaaaagaatacttaatgtaatgatttaaattgcttattttgttattgtgaattgggagaaagcaaattttagcacaggattcaaagaagtaacaatggcctactgacttagaaaagtccagccagggaatttcccaagactctaagccatgaggcaggccctcagagacactggctcctcttccctgtccaagaaaatgaaaaaatgcataactacagagnatcgaagagacacccaggcatatgccaactcaaaatgaactactttgcaaggcc

SEQ ID NO: 55723 - DNA, 252 bp, Homo sapiens
aatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggt

SEQ ID NO: 55724 - DNA, 470 bp, Homo sapiens
  misc_feature 8: n = A,T,C or G
gagcaganaagagggagaaagcagcatcttgcctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaaagttggaacgactttatctgt

SEQ ID NO: 55725 - DNA, 475 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaacccgaaggtga

SEQ ID NO: 55726 - DNA, 488 bp, Homo sapiens
  misc_feature 420, 424, 425: n = A,T,C or G
gggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgattagattggggntggnngggggttttatttctgaaagtaaaacttgccataaattagaaaacaatttcccaaaataaaat

SEQ ID NO: 55727 - DNA, 473 bp, Homo sapiens
gggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttcatgtaagtttaattatctgcatttatcttttttcctagtttttctaatactaatgttatttcttaaaattcagtgagatataggataaaata

SEQ ID NO: 55728 - DNA, 489 bp, Homo sapiens
gagaccttggggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttattttaaaagttgtaggtgattaaaataattttgaaggcgatcttttaaaaagagattaaacccgaaggtgatttaaaagaccttg

SEQ ID NO: 55729 - DNA, 262 bp, Homo sapiens
  misc_feature 15: n = A,T,C or G
attactgattaattnttctatgaggcaagcatttctcctagtgtaagtacagatgaagagaccacaagtaaagacaattacaggtgaatattctttacacatataaatgcaaaactctttaccaaatactaggaaaccaaattcctaaacaggattatgccctatgaccaagaagaatttatcttataaatgtaagggtagttcaatgtaagaaaaccaatcaatgtaaagcagcacattgaaattaccgatgtaatacagc

SEQ ID NO: 55730 - DNA, 253 bp, Homo sapiens
  misc_feature 39: n = A,T,C or G
gaagcagattctgtatatgttggtaactacccaccaagnagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggc

SEQ ID NO: 55731 - DNA, 472 bp, Homo sapiens
tacttaaggataataggacaagacaaattacagattgtctcagagaaaacaaatgagttactctctcggacaagctgtaggtcctacctaaatgtccagcaggacattagacagccgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattaatgtatccaaactgaaattatctgctttctgcattagaatgtaagccccctga

SEQ ID NO: 55732 - DNA, 473 bp, Homo sapiens
  misc_feature 459, 470: n = A,T,C or G
gaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaanaagtggggggnggg

SEQ ID NO: 55733 - DNA, 284 bp, Homo sapiens
aaaccaaactctatctgaaatcccaacaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataact

SEQ ID NO: 55734 - DNA, 439 bp, Homo sapiens
  misc_feature 356: n = A,T,C or G
aaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacattccgc

SEQ ID NO: 55735 - DNA, 250 bp, Homo sapiens
  misc_feature 35, 82, 85, 97, 112, 117, 153, 199, 239: n = A,T,C or G
cataaaccctggcactggttacaaagctcagctgngaaaatgaaatttgtagtatttttaaacatgaatgtcaatttcaagngtntttgaaatggtncctccaggagagatntttgngcaccattaggaaaatcttctctgcagaggaagtanccttctttggagaaaatggaaaatgggttctgatatgtgatctcanagtagcccatttcctagggcaccatggaaaacacaaatgngatctttaagt

SEQ ID NO: 55736 - DNA, 371 bp, Homo sapiens
gatataaaagatgcagggtaccccaaaccaattttcaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtgggagagg

SEQ ID NO: 55737 - DNA, 474 bp, Homo sapiens
  misc_feature 431, 441: n = A,T,C or G
gcagtcagagaaagtagcaggatagagacgccgagagaggagtatatgtgggtcacagcagtgagctcccacccgccctgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccacttggttggctaaaatatttatatttacctgacatgatttgttggatttggggggctangggaagttcnttaaaacaacaataaaaaatcttctgtggctgc

SEQ ID NO: 55738 - DNA, 456 bp, Homo sapiens
gaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatg

SEQ ID NO: 55739 - DNA, 409 bp, Homo sapiens
  misc_feature 6: n = A,T,C or G
tcggcntttattggccgggggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccct

SEQ ID NO: 55740 - DNA, 109 bp, Homo sapiens
  misc_feature 5: n = A,T,C or G
aaganaggctgagtacggatgggaaactattgtgcacaagtctttccagaggagtttcttaatgagatatttgtatttatttccagaccaataaatttgtaactttgtg

SEQ ID NO: 55741 - DNA, 464 bp, Homo sapiens
atatttttccggtttgaagtgtctttcatgatctttgtttctgcctgggctgaaaaataacccctgtatctgtcaattacaaggctctttagttaaacttccttagattagaatttctatagatattttatctctgtctttcccttgactaaaagtaacaaaaatggcagatggttaattttatgattgacatactgtagtctccttatttaatttatggctaatgatctatactattcatataatttagctactctatttttgtcccttattaacacaaattcattgtttatctgtacaaaggatcatgaaagatgtttttcattctataaaaataaataggctgccaggtacagtggctcacatgcttgtaatcccaacacttcgggaggctgaggcaggcggatcacacggtcaggagtttgagaccagcctggccaatatggtgaaacactgtctctact

SEQ ID NO: 55742 - DNA, 393 bp, Homo sapiens
gggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatttttctcttacctgttatttatcaatttttcccagtatttttatacggaaaaaattgtattgaaaacacttagtatgcagttgataagaggaatttg

SEQ ID NO: 55743 - DNA, 154 bp, Homo sapiens
  misc_feature 72, 80, 84, 154: n = A,T,C or G
ggaagaacggggctcttctcattttacccctccctttctcccctgcccccaggaactgggccacttctgggnggggcagngggncccagattggctcacactgagaatgtaagaactacaaacaaaatttctattaaattaaattttgtgacgn

SEQ ID NO: 55744 - DNA, 395 bp, Homo sapiens
atagtacacggcatgcagcctgtccagtgctagttggcaacaaatgggtatccaataaatggctccatgaacgtggacaagaatttcgaagaccttgtacgttgtcagaattggaatgacaaacaggcttcccttttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaac

SEQ ID NO: 55745 - DNA, 444 bp, Homo sapiens
ataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttgc

SEQ ID NO: 55746 - DNA, 440 bp, Homo sapiens
  misc_feature 21: n = A,T,C or G
gacttccttgtttgctcaagnaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaagtgaggcacagcgataacttcttcacatgctatttcaaaaagcctgtttaataaagctgaatgttaaggtg

SEQ ID NO: 55747 - DNA, 470 bp, Homo sapiens
  misc_feature 4, 7, 16, 20, 22, 27, 32, 41, 43, 46, 47, 73, 81, 159, 188: n = A,T,C or G
taangcnctaactttngctncngaccngtgcnatcataatntngcnncatacttcctctacactgttgcctgnatccaccnaactataggcaaataaatggagaccagtcccacaaggatgacaaccagtcgttgtgtgctggctgatgttaatcagcntggccaatgatttgaaagaagtttggatntcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatg

SEQ ID NO: 55748 - DNA, 473 bp, Homo sapiens
  misc_feature 14: n = A,T,C or G
gtaaggcagacagnaacattttctttatttctagaatttctcatctactacatggatcatagtaagatttttatctggaaactgagccttacacaacaaagatttgtttatagcagatgtgtatttagtagattagtggatatatttgttgtagggtgaaaatttagtagaaatataaactgctatattctatcccttgaaatcacgtagaacaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaact

SEQ ID NO: 55749 - DNA, 472 bp, Homo sapiens
  misc_feature 19: n = A,T,C or G
aaaggagaaaggggacagnacgtaaacgtgttcaataccatccctaccaccagaagctatccacaacttcgcagagtgtttcagaaatacaccaagtacagtaagcatgacatgaacaaagttctggacccggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctat

SEQ ID NO: 55750 - DNA, 463 bp, Homo sapiens
ggcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctaccagtgccagctgtttatgtataccagatgttgtaaaataattctaacttaaaatgggaagat

SEQ ID NO: 55751 - DNA, 424 bp, Homo sapiens
gagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagacctttttgttaaataaacttttgtaatagtc

SEQ ID NO: 55752 - DNA, 402 bp, Homo sapiens
  misc_feature 11, 20: n = A,T,C or G
actctttagcngtttctttnaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaag

SEQ ID NO: 55753 - DNA, 443 bp, Homo sapiens
cacaaacaagtctgtacttgtcctcctactctacaaatataaatatagtatgtgatgtaggcctttggacaataagttatcagttcataatttattctgtttattaaactgaaatacggtttgataaaagtatgtgcattgaaatatcaggcattaaatgagtctggaaaaaaagcattcaaagttgagtggaaaagagttggaaatatattttaaaggtaattatagaaaataaggttagtacaaaattgacaatgttgttatgtttctataatatggttatgaataccttcaagttaactctaggttaacaagcttgcatgtttcttacccttactcattcttactccatagacaaaaggtccaaatcactgacactattcactagaaaggagatttcttagtaggcatgtgctttagtattgaatatgctgtaagggtat

SEQ ID NO: 55754 - DNA, 500 bp, Homo sapiens
  misc_feature 9, 16, 440: n = A,T,C or G
gcggggaanttcggcnttatggccggaagaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggcttggcagagcataagtacatccaggttgtctaccttcataacaacaatatctctgtagttggatcaagtgacttctgcccacctggacacaacaccaaaaaggcttcttattcggggngtgaagtcttttcagcaacccggtccagtactgggagatacagccatccaccttcagatg

SEQ ID NO: 55755 - DNA, 482 bp, Homo sapiens
  misc_feature 103: n = A,T,C or G
gaatttggagaagatagaagtttgaagtggaaaactggaagacagaagtacgggaaggcgaagaaaagaatagagaagatagggaaattagaagataaaaacntacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattgggagaagttttagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgaagggtgtttaccgtaggccagaaccaatt

SEQ ID NO: 55756 - DNA, 338 bp, Homo sapiens
cgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggtttt

SEQ ID NO: 55757 - DNA, 273 bp, Homo sapiens
catggtggctcacgcttgtaatcccagcactttgggaggccgaggcaggcggatcacgaggtcaggagatcgagaccatcctggctaacacggtgaagccctgtctctactaaaaatacaaaaaattagccaggcgtggcagcgggtgcctgtagtcccagctactcgggaggctgaggcaggagaatggcgtgaacctgggaggcggagcttgcagtgagctgacatcgtgccactgcactccagcctgggtgacagagcaagactccgtct

SEQ ID NO: 55758 - DNA, 473 bp, Homo sapiens
ctggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatccca

SEQ ID NO: 55759 - DNA, 416 bp, Homo sapiens
  misc_feature 370: n = A,T,C or G
gaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttttgttcaaatgattttaattattnggaatgcacaatttttttaatatgcaaataaaaagtttaaaaacct

SEQ ID NO: 55760 - DNA, 462 bp, Homo sapiens
  misc_feature 456: n = A,T,C or G
ggacaactcggtggtggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaggaaagaacttgcatgttggtgaaggaagaagtggggnggaaga

SEQ ID NO: 55761 - DNA, 467 bp, Homo sapiens
  misc_feature 411, 441: n = A,T,C or G
taagcaaatgtctctcaaaaaaaattgtatttctgtgcacattagctgagattcacacattttgcacctcagtagtatttcagatgagactcaatgtgtggagaaaaccgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttttcttatagnacaaataatttttcagatcccagctttggnaaatgtgttaattctactttgggaat

SEQ ID NO: 55762 - DNA, 345 bp, Homo sapiens
gggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgtttgggaagttgttaatatctgctacttggaacatacgattgcctttcagaataaatattgg

SEQ ID NO: 55763 - DNA, 480 bp, Homo sapiens
acccaaaattgatgagagcaaaggggtcgcaccactatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaatttttgaagacttgggttactaatgattgtatctttgctagtcaacaacttatgaaatatactcaatgcgtctgatgtgtcattaagtgcagaaataactaagacacaaataacctttgc

SEQ ID NO: 55764 - DNA, 368 bp, Homo sapiens
gagtcgggggtggtgggagaaggaggaggcggcgaatcacttataaatggcgccgaagcaagacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaag

SEQ ID NO: 55765 - DNA, 468 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatctttttaaaaagagattaaaccg

SEQ ID NO: 55766 - DNA, 418 bp, Homo sapiens
  misc_feature 417: n = A,T,C or G
tataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaatttttttttagtgccagtccctgaacatatcattgaaagttaattttctttgcattttaaaatatctggattatgaagaaaaagtgatgaaaataaattaaaactgant

SEQ ID NO: 55767 - DNA, 419 bp, Homo sapiens
acaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgactttatacaattttgctcaggcaaccaaggacagagtatcggcagaaacatggagtgcttttgtataggccacctgtacataaaagtgtaattatttattttaattttcccatttgtatcatattaaagctttgtacagtgttttt

SEQ ID NO: 55768 - DNA, 301 bp, Homo sapiens
ggggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtg

SEQ ID NO: 55769 - DNA, 181 bp, Homo sapiens
atctgtaggctattcatttctctaacagcagtaatattaataattttcatgatttgagaagccttcgcttcgaagcgaaaagtcctaatagtagaagaaccctccataaacctggagtgactatatggatgccccccaccctgccacacattcgaagaacccgtatacataaaatctagac

SEQ ID NO: 55770 - DNA, 299 bp, Homo sapiens
aacagctaaaagagcacacccgtctatgtagcaaaatagtgggaaggtttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaagcgttcaagctcaacacccactaccca

SEQ ID NO: 55771 - DNA, 330 bp, Homo sapiens
atctgaaaacaccaggatccatctgggcttctcttccccagctttttgcctgatgccattttattgacagacaatggactttgaagtcggcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagagtagaagg

SEQ ID NO: 55772 - DNA, 390 bp, Homo sapiens
tgggattttgtttggtattacattttaattgtagatttaaactttcctctgtaaccaatgtaatgtgggccctgttttggagcagagagtaccttgcacccattaatgcttaatctttccggcccggcacagtggcttatgcctgtaatcccagcactttgggaggccaaggcaagtggatcacctgaggtcggcagtttgagaccagcctggccaacatggtgaaactccatctctactaaaaaaaaattagctggacatggtggctggtgcttgtaatcccagctactcaggaggctgaggaaagagaatcacttgaatccaggaggtgggaggttgcagtgagccaagatcgcgccattgcactccagtgtgggtgacagagtgaga

SEQ ID NO: 55773 - DNA, 233 bp, Homo sapiens
ggaagatgggaaggttttgaaggtcacaggtcatggccagtgatgggctttggtgggcttcgggtacagataagtccccagctcatgatatttcaacttaatgattttttgactttatgatgatgcaaaagctatgtacatccagtagaaaccatactttgagcacacatataatcattctgtttttcactttcagtattcaataaattacatgagatattcagcattttatt

SEQ ID NO: 55774 - DNA, 466 bp, Homo sapiens
gagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaaggggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacg

SEQ ID NO: 55775 - DNA, 474 bp, Homo sapiens
  misc_feature 464: n = A,T,C or G
gtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatggntaattttctg

SEQ ID NO: 55776 - DNA, 447 bp, Homo sapiens
gaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttg

SEQ ID NO: 55777 - DNA, 471 bp, Homo sapiens
gctctacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaac

SEQ ID NO: 55778 - DNA, 253 bp, Homo sapiens
  misc_feature 11, 12, 41: n = A,T,C or G
tggcccggganntttcaaacagcagtaatcaaaaagtgatnctagtgtaatgaaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcct

SEQ ID NO: 55779 - DNA, 472 bp, Homo sapiens
  misc_feature 432: n = A,T,C or G
gattcctgaagctgacagcattcgggccgagatgtctcgctctgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattnggatgaaattccaaattctgcttgcttgctttttaatatt

SEQ ID NO: 55780 - DNA, 468 bp, Homo sapiens
  misc_feature 462: n = A,T,C or G
gcttttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgangggggg

SEQ ID NO: 55781 - DNA, 462 bp, Homo sapiens
  misc_feature 8, 437: n = A,T,C or G
gcaagaanaaaaatccctgccttccaaagaaacgattgaacaggagaagcaagcaggcgaatcgtaatgaggcgagcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttatgttcaaatgattttaattattnggaatgcacaatttttttaatatgc

SEQ ID NO: 55782 - DNA, 472 bp, Homo sapiens
gaggtcacaaagagagagagaaaacagggtagagagagaaagacccagaagcagagaaagctaaagaactaaagagagacagaaggagagagaaactgagtgagaaagaaagtcaagaagaaaagagagagagtaaaattggcagaaagagaaaagaagcaaataacactcacatggacagacaaaccctgagagatagacagagaagtggggtgttgcgggtattgcagagagatgaagagttagaatgtgatacaggaagacagagacagagacaaagcagagagaacacacagaaggagcaagggacagagaaagaagtgagggagatacatacagagccagagacagatcatcatagagagaagcagagaccacaagagacagcaagatagaaaagacagtgagatagcgagagaaagagagtcagtgaaagtcactcagacagagagagttggccagatggagcttt

SEQ ID NO: 55783 - DNA, 353 bp, Homo sapiens
aaccaccagaattctatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcat

SEQ ID NO: 55784 - DNA, 372 bp, Homo sapiens
gttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcacgatcttgctactgtgatattttaaatatccacagtactcactttttccaaatgatcctagtaattgcctagaaatatctttctcttacctgttatttatcaatttttcccagtatttttatacggaaaaaattgtatttgaaaacacttagtatgcagttgataaga

SEQ ID NO: 55785 - DNA, 169 bp, Homo sapiens
ggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttagc

SEQ ID NO: 55786 - DNA, 329 bp, Homo sapiens
gaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaag

SEQ ID NO: 55787 - DNA, 471 bp, Homo sapiens
  misc_feature 385: n = A,T,C or G
gtgaggcaaaaacgagatgaagaggtgcagcagtacagggaacagctggaggaaatggaagaacgccagaggcagttaagaaatggggtgcaactctagcaacagaagaacaaagagatggaacagctaaggctcagtcttgctgaagagctctctacttataaggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtngggaagttgcaaatacttggctgacctgcttaaaaagattctagaagttggccggaggcagaacatgtcaactctttgctggattc

SEQ ID NO: 55788 - DNA, 104 bp, Homo sapiens
ggaacgtttacattaacaagagaaaaaaggtaataagctgaaactctacctagccagcaaatagtagaggaaaagaggagaaaccaacaaagtaaactaaattg

SEQ ID NO: 55789 - DNA, 473 bp, Homo sapiens
  misc_feature 13, 424: n = A,T,C or G
ggtccaaccgagnaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagaagaaagtctcctggagtagaaataaaaagtttgagagaattggatagtggattnggaagtgcataaaatagctgaaggtttttcagaatccaagaaaaggtca

SEQ ID NO: 55790 - DNA, 157 bp, Homo sapiens
gactcttagcggtggatcactcggctcgtgcgtcgatgaagaacgcagctagctgcgagaattaatgtgaattgcaggacatattgatcatcgacacttcgaacgcacttgcggccccgggttcctcccggggctacgcctgtctgagcgtcgcttg

SEQ ID NO: 55791 - DNA, 406 bp, Homo sapiens
  misc_feature 9: n = A,T,C or G
aagctaatncatttacccaaacctgatttagaaatatagaggtgcttttaggaattgtttgaattttaaaaaatcatctccatttcaaatacaacttatgaattttgatatcctgttgtataatactagaaatatagagatgcagtatgcttcgtgtctttctaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatga

SEQ ID NO: 55792 - DNA, 437 bp, Homo sapiens
  misc_feature 257, 263, 309, 397: n = A,T,C or G
attgtttgtagtgctatccattcctctcctgagattttaacttactactggaaatccttaaccaattataatagctttttttctttattttcaaaatgatttcctttgctttgattagacactatgtgcttttttttttaaccatagttcatcgaaatgcagctttttctgaacttcaaagatagaatcccatttttaatgaactgaagtagcaaaatcatctttttcattctttaggaaatagctattgccaaagngaaggngtagataatacctagtcttgttacataaaggggatgtggtttgcanaaaaattttctttataaaattgaagttttaagggacgtcagtgtttatgccatttttccagttccaaaatgattccattccattctanaaatttgaagtatgtaacctgaaatccttaataaaatttg

SEQ ID NO: 55793 - DNA, 403 bp, Homo sapiens
  misc_feature 36: n = A,T,C or G
agcttctccaggggaggaccaccaccagggccaagnagcccctccccacaccctagagcactcacgttgagcttatagggcatagactcgaagaagatggacgtggctgatatccgcttgacgtcagacatgtagccgtgggtgagactgcgaagtgagaggaagtaagaaggcctgggtggaaggacccccggacttaaccactcccttcaactccacagttctctgtccccagaacaccagtcctaggacacaccgcctcactgctctgtccactctgtggtaggcactataactgggatcttatcttcctcatccactgtgacatgcaggacagggcaaggcctgttccatctgtatggtccacagtaggtattcaataaataactcctttcccacaccc

SEQ ID NO: 55794 - DNA, 282 bp, Homo sapiens
ggagaggacttccaaatgtggttacctcagctatatcactgcccaacatcagaaaacctgacggctatgattactatgccttttctaaagatcaatactataacattgatgtgcctagtagaacagcaagagcaattgctactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 55795 - DNA, 470 bp, Homo sapiens
tcatcaagagactgaatcagggggtctagggctcagcacaggcaccctttttgtttttgcagtttcacaggaattctgatgtgccagtgattgtcaggtttgtccctgggcaggacccacctgcctgaccttctgtccccctgggacacagtatttccagagaggtgcttcagttgccccaccacgacttccagcgccccccatctctgtatgcagctgagctcatgatggagcccactgtgtgctttttgttgttgttacattcctataaaaatgtccacgcatatttgaacatctgtgttcatagtggcattattcacaatggctacaacacgaagaaagcattccaagtacctatcgatgaataagcaaaatattacacacacaggaatattattcagccttgaaaggaaattcggacacgtgctacaacatagatgaatcttgaggacggtatgcaaagtgaaata

SEQ ID NO: 55796 - DNA, 412 bp, Homo sapiens
  misc_feature 6, 10, 28, 41: n = A,T,C or G
aaatgntgcnaaacagtctttgaatatngaacacgccggcntgacgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttat

SEQ ID NO: 55797 - DNA, 472 bp, Homo sapiens
  misc_feature 29, 430: n = A,T,C or G
agaaaaaaatgtttatacaaccctaagtnaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttnggtgtacaaaactttttatatcaaaaggctttgcacatttct

SEQ ID NO: 55798 - DNA, 466 bp, Homo sapiens
catgtatcagaatttcattccttttgatgaccaaaaatattatcaagtatatggatatgctacattttttatccattaattcactgatggacatttgggttgtttccatttttagctaccatgaatattactctgtgagcattcatgtacaggtttttgcatggacgtaagttttccattctcttgggtgtatatatttaggagtagaattgccgcatcatatggtaactctgtttaaccttctgaggaactgtcaaaatgttttccaaagcaactgaaccactttacgatcacaccagacatgaatgagtgttgcagtgtccccacatcgtaacttgttactgattttgtattatagctgtcctagtggatagggaagtgacacctcatgattttcatttgcatttcccagtgacgataatgtgagcatcttctgaaatgacatttgtatgttttctttggaaga

SEQ ID NO: 55799 - DNA, 471 bp, Homo sapiens
atcttcttgagtacccaaaccggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaataatttaaac

SEQ ID NO: 55800 - DNA, 185 bp, Homo sapiens
gtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaatt

SEQ ID NO: 55801 - DNA, 256 bp, Homo sapiens
  misc_feature 17, 20, 201, 228: n = A,T,C or G
agggaacaaaaataagnatnacaatcaccaatgacccgaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtnaactttcctctgaagataaggagaccntggaaaaagctgtagaagaaaagattga

SEQ ID NO: 55802 - DNA, 229 bp, Homo sapiens
tgcacctgaggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggattttttattaaagaaaaaaaatttc

SEQ ID NO: 55803 - DNA, 172 bp, Homo sapiens
  misc_feature 18: n = A,T,C or G
aattaaagatcataaagnactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagca

SEQ ID NO: 55804 - DNA, 236 bp, Homo sapiens
  misc_feature 236: n = A,T,C or G
tcattacagggtcaaggaaagatttgaaatgtcagaaggagtaagcaaacttaatataatgggaataccagaaggagagtcttccaagtagagagagaataagaaaaaatatttgaagaaaattggctgaatactttgaaaaatatttactaggtaatattaatctatacatctgagttctattaaatctaagtagaataaatacaaatcaatccatgaccagactaatcactgtn

SEQ ID NO: 55805 - DNA, 371 bp, Homo sapiens
ggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaac

SEQ ID NO: 55806 - DNA, 273 bp, Homo sapiens
  misc_feature 6, 31, 223, 247: n = A,T,C or G
gagtgngtgtgagcatttaagaagcatcctntgccaagaccaaaaggaaagaagaaaaagggccaaaagccaaaatgaaactgatggtacttgttttcaccattgggctaactttgctgctaggagttcaagccatgcctgcaaatcgcctctcttgcttcagaaagatactaaaagatcacaactgtcacaacccttccggaaggagtagcctgacctgacncagattggatgtccaatggtccanggatctttttctgggatggggaaagg

SEQ ID NO: 55807 - DNA, 297 bp, Homo sapiens
  misc_feature 7, 297: n = A,T,C or G
atttatngagaaggatattttgtagtagtattgtaatgtgttatgtagtacagttttaaagctataaatggaattttgtgtaaattcacaaaaatgtgatataaacaggatctaagactggattccctgtcactaaactgcaccactatacctgtctctctgtgtgggggacacttgctgatgattcccaagattgagatgatgacggtgaggacgactgggtgaacagccatcacttcaacattgtgataatccttcacagcaagaaaccgaataaaatactaacattttcttaan

SEQ ID NO: 55808 - DNA, 276 bp, Homo sapiens
  misc_feature 245, 247, 269: n = A,T,C or G
gctgagggggcaggcggagcttgaggaaaccgcagataagtttttttctctttgaaagataaagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctngnttcgtggagtgaaaaatgtgtnttaaaca

SEQ ID NO: 55809 - DNA, 420 bp, Homo sapiens
gaggccttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagg

SEQ ID NO: 55810 - DNA, 258 bp, Homo sapiens
  misc_feature 6: n = A,T,C or G
ggggtnattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttct

SEQ ID NO: 55811 - DNA, 283 bp, Homo sapiens
  misc_feature 6: n = A,T,C or G
atctgngttacacgtgatctgcttaccaagtcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgattt

SEQ ID NO: 55812 - DNA, 328 bp, Homo sapiens
gggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtg

SEQ ID NO: 55813 - DNA, 418 bp, Homo sapiens
  misc_feature 6, 15: n = A,T,C or G
ggggcnttcctgaanctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaga

SEQ ID NO: 55814 - DNA, 372 bp, Homo sapiens
  misc_feature 8, 22, 34: n = A,T,C or G
caaagccntaggcaacaaaagnagaatacacaanctggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatg

SEQ ID NO: 55815 - DNA, 466 bp, Homo sapiens
  misc_feature 30, 35: n = A,T,C or G
aatacatggtatgaggtagcactggcaacnctganaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactcctt

SEQ ID NO: 55816 - DNA, 321 bp, Homo sapiens
gggcgctccaaggtcatctgtgagcccgcgttgtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctg

SEQ ID NO: 55817 - DNA, 191 bp, Homo sapiens
  misc_feature 164, 182: n = A,T,C or G
atattattattttattaacacattaaaaaatacccataagaggattatagagtttttccctatcctacttctcagagtgttttaagcacactgtagaatttattcactcatgaatttgatacaaactaaagtgaaaatctcttctcaggaacctcatatggctnaagaaagcatagtacccncgttcagag

SEQ ID NO: 55818 - DNA, 359 bp, Homo sapiens
attgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagagggctaaatgaatattatccctaatacctgccaccccactcttaatcagtggtggaagaacggtctcagaactgtttgtttcaattggccatttaagtttagtagtaaaagactg

SEQ ID NO: 55819 - DNA, 377 bp, Homo sapiens
  misc_feature 11, 13, 28: n = A,T,C or G
ggaaagccagnanaaaggaaagccaagnatgacttattttgatcgttttaaagttatgaaggcaaagaaaatgaggaacagaataatcaagaatgaagctaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagccccagaaggttcctgcccagaaagccacaggccagaaagcagcgcctgctccaaaagctcagaagggtcaaaaagctccagcccagaaaagcacctgcttccaaaggcatctggcaaga

SEQ ID NO: 55820 - DNA, 301 bp, Homo sapiens
tacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttg

SEQ ID NO: 55821 - DNA, 426 bp, Homo sapiens
  misc_feature 7, 33: n = A,T,C or G
aaacagngaagattctgcagaatatcagttctntgggacttattctacaaggctagatgaacagtgtagtgctattcccacccgtaccatgcatttcgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagcctccagagatagtcattaaagtggaaaaacttgaccctgagctagactcctaatctagcttgccattattgtgtg

SEQ ID NO: 55822 - DNA, 357 bp, Homo sapiens
cgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 55823 - DNA, 447 bp, Homo sapiens
  misc_feature 442: n = A,T,C or G
gaaactcggtggtggccactgcgcagaccattacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaangaaga

SEQ ID NO: 55824 - DNA, 351 bp, Homo sapiens
  misc_feature 24: n = A,T,C or G
tcaaagagctgcccatgttgtggnactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaaga

SEQ ID NO: 55825 - DNA, 284 bp, Homo sapiens
ggaggccaggcgtgttggctcacgcctgttttcccagcactctgggaggccaaggcaggtagatcgcctgcggtcaggagttcgagaccaccctgaccaacatggtgaaacctcgtctctactaaaaaaatacaaaattagccaggcgtggtggcacatgcctgtaatcccagctacttcggaggctgaggcaggaaaatcacttgaacccatgaggtgaaggttgcagtgagccgagatcgagccattgcagtctggcgtgggcaaaagagtgaaactcagtc

SEQ ID NO: 55826 - DNA, 210 bp, Homo sapiens
  misc_feature 11, 18: n = A,T,C or G
gaaggcaaagnagccagnaagtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactctg

SEQ ID NO: 55827 - DNA, 355 bp, Homo sapiens
atatttggaggactcatggacaagaaacagaatgtgaagtactatccaaaaacaaacgccttgtactttgtacgagcaaagagataatgtgttctaaaccccttttccttttctgtggcttttaatttggaattttccagtgtgtaagcatttggactgagaattgggaaaacaaaattactcccagaagccaaaactctttaattcccaaccgaagtcactccaggctgggatcaaatctccattaagaaaaaaaattatatataaatatatatatatattatatagccaactctgttgacaaaaaaagggagagatttccatcctggttcagataaagttgttgctgtgtttt

SEQ ID NO: 55828 - DNA, 210 bp, Homo sapiens
atcataaatgaatataatatactagtatatagcaatgtatttagaatggtcatatttaaggatattttcagatttgatctagttagaagcatattgaaattaacattctcaactactaattatttcaccacagtttaaaatgtgataaatgtgtaccctttgttacctttaaaatattaagccatatgaatatatgacctattcagaact

SEQ ID NO: 55829 - DNA, 436 bp, Homo sapiens
  misc_feature 6: n = A,T,C or G
gttttnattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaagtaaatttctcctttatattctaagaagctttaaaagaacaattcaggggttattgataactgctactctgtcggtcattgtctctatatgcagtaaaattttatggtccctttataggaatataaaaaattcaaaacagtttttcaaaagatttttttccttggacataaaaaattttgatgctattctatttttg

SEQ ID NO: 55830 - DNA, 212 bp, Homo sapiens
  misc_feature 8, 59: n = A,T,C or G
taagctcnagcgatttctaataaaattttagttgtacacttttagtagtcatagtgaancaggtctagaaaataagcctttggcagggaaaaagggcaatgttgattaatctcagtattaaaccacattaatctgtatcccattgtctggcttttgtaaattcatccaggtcaagactaagtatgttggttaataggaatcctttttttttt

SEQ ID NO: 55831 - DNA, 173 bp, Homo sapiens
  misc_feature 31, 69: n = A,T,C or G
ggaagcaatacgaaatgatctgctgcagtgntctgagccctaggattcatctttcttttcaccgtaggnggcctgactggcattgtattagcaaactcatcactagacatcgtactacacgacacgtactacgttgtagcccacttccactatgtcctatcaataggagctgt

SEQ ID NO: 55832 - DNA, 390 bp, Homo sapiens
  misc_feature 10, 26, 34: n = A,T,C or G
caacttgagnaagtttgacataaagnagcttctncaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttg

SEQ ID NO: 55833 - DNA, 441 bp, Homo sapiens
gaaggccttgaggcagccagcgcaggggctcttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagg

SEQ ID NO: 55834 - DNA, 439 bp, Homo sapiens
gacaaccttagccaacctttacccaaattaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 55835 - DNA, 381 bp, Homo sapiens
  misc_feature 6, 30: n = A,T,C or G
gggctnagccgacattgccggcgtcttggntattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaatcctgtcttgttcataaattgacaatgtcaataaattgaaatatggttcactgttaaga

SEQ ID NO: 55836 - DNA, 423 bp, Homo sapiens
  misc_feature 11, 31, 32: n = A,T,C or G
gagacccaagnacgccgggcctacagcgggnncgtgaggaaagtcgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttg

SEQ ID NO: 55837 - DNA, 418 bp, Homo sapiens
  misc_feature 32: n = A,T,C or G
aatatcaaagccctgtggacaggacagttttnatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattatttt

SEQ ID NO: 55838 - DNA, 374 bp, Homo sapiens
tatggccgggatactacgtgctcaataaatagttgttgaattatgaatgaataagaggtttaaaaagtttcctacttagatgtcttatctaaataaataaaacaaatgctaccaacttgacttctttttgactgaagtattaagaaacctaagattttaacattaccaagattttaaatgaaaaatatgtggatatcaatttgttgttgttttatatgtgcatatagatactttcatgttgttttatatgtgcatatcaatacttcttgtaataatggtgaatttgatgtgaaaaagatatatgcttatgtgtttttgttttaactgtgtataaaattcttttagattttacaataaaccacaaatttttctga

SEQ ID NO: 55839 - DNA, 408 bp, Homo sapiens
  misc_feature 7, 34, 35: n = A,T,C or G
gactccngtcctcaaaaaaagaaggcagctggtnngatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagcc

SEQ ID NO: 55840 - DNA, 490 bp, Homo sapiens
gttgacttgggtgcaaaaaaaatgaagtaataacaatttgaggagagccctctatatctgtataattcagatttcttccaaatgtaaatcatgccttttctttaagtattctaggcttactggccctttgttttatccctaaggagcacccaatgcttagaaaaatgtgaaatgtagaaacaggatttgacagaaatttagaaagctagagattggaaagaaaattataatgggatgtttaaaaataatttaggccaggcgtggtggctcacgcctgtaatcctaacactttgggaggccgaggctggtggattgcctgagctcaggagttcaagaccagcctgggtaacacagtgaaaccctgtctctactaaaatacaaaaaattagctgggcgtggcggcacacgcctgtagtcccagcttcttgggaggctgaggcaagagaattgcttgaacctgagaggcagaggttgcagtgagcccgagatt

SEQ ID NO: 55841 - DNA, 490 bp, Homo sapiens
  misc_feature 32: n = A,T,C or G
gcttaccagttcttctttctttcttaagtccntttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaaca

SEQ ID NO: 55842 - DNA, 161 bp, Homo sapiens
  misc_feature 21, 22: n = A,T,C or G
ctttgaggagcagtaccttannattaaaaaaaaaccacaacacacagtggagagcacatgggcagcattcaagaaatacatgttgattgtgtgataaggaactgtagtcaccaaacaaatatttgttaatacttgcaatgtaaaaggtacttggctgtttt

SEQ ID NO: 55843 - DNA, 487 bp, Homo sapiens
  misc_feature 5, 9, 20, 31, 33, 34, 60, 486: n = A,T,C or G
gaagnacanagagagccagnaccttgtctcntnnaataaaaaataaaaaaataaaaacanaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaaatttttggtcattaaatcgaatgtatattattactttttaattttctaagtatttatcacaggactttaacaccatatatttccctcccagtttttctccccttttggtttaatagttaaaacatttttcataattagng

SEQ ID NO: 55844 - DNA, 215 bp, Homo sapiens
  misc_feature 14, 26, 33: n = A,T,C or G
gggagcaaaatagnaaacattccagnatatagntttcatttttgagaacttgagtaatcagaatttactgttctgtaaagaataaaggaaaggaaaattataaagagagaaatttctctttaaagccctcacagaatgtgctagaaatagaataaaatttaaaatacttttggcttcttttcctcagcttaagttcaaaataaaagcaatccttt

SEQ ID NO: 55845 - DNA, 440 bp, Homo sapiens
catatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtgactattttgg

SEQ ID NO: 55846 - DNA, 456 bp, Homo sapiens
  misc_feature 25, 405: n = A,T,C or G
gtactggatacataagggaatgccntcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgagaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaaganaagccttggctccctgtgaaggattaacttacagagaagcaggcaagatga

SEQ ID NO: 55847 - DNA, 411 bp, Homo sapiens
  misc_feature 2, 235, 253, 303, 405: n = A,T,C or G
cnagtcaccctgatttgatcttatacattgtatgcttgtatcaaaagttcaaatatacttcataaatgtgtacagctattatgtatccataaaaaaaaaattttaagtttagtcctaaattcattagtaaatttacatttatatataataatatgtataattgtcccttttttttaagtttagcaaacactgtaacaacttcttctccaaaagcagtaaatatattttttagttngatcataaacatttgagngtatagtatgaagaagttctaggctagggatagtatcacccattcgtatngtttaaaatctttaccaaattgaaaatttttatagttttgagaaattagtagttttagaaaaaaactgaggaaattaataccagaaattcctggcagtttgngttttg

SEQ ID NO: 55848 - DNA, 197 bp, Homo sapiens
tgcttacttatcttttaaatgtttcttttattacaaagcctattttgagtagcttttaaaactgaatttcctttaattggtttgaagcctagagatgaatttcgttttcaaatatctggtgggatggtaatggggattagagaactgacatgagaaaaggggagctgttttggtattaaacgaataaaatcttaagc

SEQ ID NO: 55849 - DNA, 248 bp, Homo sapiens
ccagcactttgggaggccaaggtgggcagatcacgaggtcaggagatcaagaccatcctggccaacatggtgaaaccctgtccctactaaaaatacaaaaattagccaggtacagtggcacacacctggagtctcagctattcaggaggctgaggcaggagaatcgcttgaacctgggaggtggaggttgcagtgagccaagatcgcgccactgcactccagcctggcaacagagcaagactccgtct

SEQ ID NO: 55850 - DNA, 340 bp, Homo sapiens
  misc_feature 22: n = A,T,C or G
tgctgtggcgctgcgtagaagnatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactg

SEQ ID NO: 55851 - DNA, 399 bp, Homo sapiens
  misc_feature 29: n = A,T,C or G
gaggccttttagtatatttcccagaaacntttaattcaagcattagaatatcatctagtcgcattccctaattttttacaggtgagacaactgatgtccaaagagattaaaaatctagtttaaggccgggtgcggtggctcacgcctgtaatcccagcgctttggggaggctgaggtgggcggatcacctgaggtcgggagttcgagatcagcctgaccaacatggagaaaccctgtctctaataaaaatacaaaattggccgggcatggcggcacattcctgtaatcttagctactcaggaggctgaggcaggagaatcgcttgaacccgggaggcagaggttgtagtgagccgagatcacgccattgcactccagcctgggcaacaagagcaaaact

SEQ ID NO: 55852 - DNA, 128 bp, Homo sapiens
  misc_feature 23: n = A,T,C or G
gatacttctctttttttgctgtnccaccaaatacaattcaaatgctttttgttttatttttttaccaattccaatttcaaaatgtctcaatggtgctataataaataaacttcaacactctttatgat

SEQ ID NO: 55853 - DNA, 116 bp, Homo sapiens
  misc_feature 3, 19, 79: n = A,T,C or G
gcngttgataagaggaatntggcataattatggggggtgattattttttatactgtatgtgccaaagctttactactgnggaaagacaactgttttaataaaagatttacattcct

SEQ ID NO: 55854 - DNA, 459 bp, Homo sapiens
  misc_feature 26, 268: n = A,T,C or G
aacccggaatattatgcatcataaantttaacaaagtcatgtcctttcagcaacatggatgtagctagtggccattatcctaagtgaattaaagcagggacagaaaaccaaatacctcatgctctcacttataatgggagctaaactctggttatacacagatataaagatggaaacaatagacactagagactccaagagggaagagggagggagtggagcaagggttaagaaactatctattgggtacaatgtgcactatttaggngacaggttcaatagaagagcaaacctcaacatcatgcaacatatccatgtaacaaacctacacatgtgcctcctgaatctaaaattaaaaagaaaaaaagagagaaggaaaaaaatggcgggggaatgagagggtatgactaaacttctctgaagaggtaacctttgaactgagccctgaataacaacgag

SEQ ID NO: 55855 - DNA, 495 bp, Homo sapiens
  misc_feature 1, 14, 40, 101: n = A,T,C or G
ntggccggaagacncttcgcaaattttaatttcctgtatnagtttctcctgaccactcactcacattctccccaaagtgaagccaatgttggtaacggagngaattctagtgggggacattggaggggatatagaaatacgtttgttcatatatgctttttaacacagatttttaattgtattagtataaaagtgtgataaacatgctttcattttaaatatcttctgaacctataaattatattccccttttaaatttttgtttaatttttatcatcaaaataaatgtatcttccagtaaggacagtgtgaggaggttggatgatttccttcttcagaaaacaggcatcaaaatactggagtaactgtgttaaatgtcagccaaaatagattgtaagaaaaggagtattattagagataaagaggaacattttcaaaattatgaagtgacaaatatggcaggaaaatataaaaattctaaatgtatatgcactt

SEQ ID NO: 55856 - DNA, 465 bp, Homo sapiens
  misc_feature 2, 6, 428: n = A,T,C or G
gnagtncagctattgtaaacagttcatgacttgattttgattcggaaatctatactgaccaaggattaatcttaaggactgtataattcattaaagcggtggtctttccatgtggagactgatagaaaataattttgtcccaagtcttatttgctgactttttctgtcaatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttnactctcctttgctcccttttccaatttcttattgcat

SEQ ID NO: 55857 - DNA, 470 bp, Homo sapiens
  misc_feature 1, 254, 360, 389: n = A,T,C or G
naaaccgaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggnagacatttatcttcatatttcttggatatatacctaggagcagaattgctgcgtcagatggtaatgctgtttaaccttttcaggaactgtcagactgttctgaagngggacattatttacattccaaccagcagngatgagaattccagtttctccacatcctcatcaacagggggaattggccggcctttttaattatattcatccggaatggga

SEQ ID NO: 55858 - DNA, 372 bp, Homo sapiens
  misc_feature 25: n = A,T,C or G
aggagctcaagcttgggaaaatggngtgcattccttgtatcgtcattccagttctgctctggatctacaaaaaattcctggagccatgtatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatat

SEQ ID NO: 55859 - DNA, 181 bp, Homo sapiens
  misc_feature 31, 32, 177: n = A,T,C or G
ataacactgcatcgtaaaaccttcagaaggnnaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaantgag

SEQ ID NO: 55860 - DNA, 292 bp, Homo sapiens
aatacagtgcaggccaggcgcggtgactcacgcctgtaatcccagcattttgggaggccaagggtggcggatcatgaggtcaggagatcgagaccatcctggctaacacggtgaaaccccatctctactaaaaatacaaaaaattaaccaggtgtggtggcgcacatctgaagtcccagctacttgggaggctgaggcaggataatcacttaaacttgggaggtggaggttgcagtgagacgacacctcgccactgcactccagcctgggcgacagagcaagactccatctc

SEQ ID NO: 55861 - DNA, 352 bp, Homo sapiens
  misc_feature 25: n = A,T,C or G
taaaggggaggtcgtggatgctgcngtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggt

SEQ ID NO: 55862 - DNA, 147 bp, Homo sapiens
  misc_feature 42, 45, 75, 79, 92, 110, 124, 138: n = A,T,C or G
gcaagaaaaaatctcatgttttaacaaagtttacagatttgngtngggctgcattcaaagctgttctgggctgcnttanacccgggggctanagttggacaagcttgtanatgatttcaggttntaaaaccagaagtncaattcaac

SEQ ID NO: 55863 - DNA, 407 bp, Homo sapiens
atgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctga

SEQ ID NO: 55864 - DNA, 297 bp, Homo sapiens
  misc_feature 25: n = A,T,C or G
gttgcagttattgctcgatgccacncatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactct

SEQ ID NO: 55865 - DNA, 490 bp, Homo sapiens
  misc_feature 6, 31, 33, 34: n = A,T,C or G
tggctnccctgaagatagatcgccatcatgntnnacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaact

SEQ ID NO: 55866 - DNA, 150 bp, Homo sapiens
  misc_feature 22: n = A,T,C or G
attttgaagataatgcaggagncatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 55867 - DNA, 490 bp, Homo sapiens
  misc_feature 7, 8, 30, 33, 58: n = A,T,C or G
aatatgnngttttgtaattttttctattgnttnctgttttaaaaatattttccaaggnagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagtt

SEQ ID NO: 55868 - DNA, 450 bp, Homo sapiens
accctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaatac

SEQ ID NO: 55869 - DNA, 435 bp, Homo sapiens
ggcatgcaagtttgctgagctgaaggaaaatattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggaga

SEQ ID NO: 55870 - DNA, 338 bp, Homo sapiens
cactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttga

SEQ ID NO: 55871 - DNA, 195 bp, Homo sapiens
  misc_feature 193: n = A,T,C or G
aagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaactaaacccntt

SEQ ID NO: 55872 - DNA, 351 bp, Homo sapiens
  misc_feature 350: n = A,T,C or G
gttttcttgtttttctcttgttgcttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcant

SEQ ID NO: 55873 - DNA, 263 bp, Homo sapiens
gtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgat

SEQ ID NO: 55874 - DNA, 352 bp, Homo sapiens
  misc_feature 23, 25: n = A,T,C or G
tggtccagacatcattccaattncngctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtat

SEQ ID NO: 55875 - DNA, 497 bp, Homo sapiens
  misc_feature 2: n = A,T,C or G
cncaataagttattactacacacctatcagaatgactaaaataagaaagtaacaacatcaagtgctggtgaggatgtgaggaaactggatcactcataatattgctgataggatacacaaaattgtacagccactctggaaaaaaaacagtgtggcagtttcctatgaacctaaacatgcaattaccatacgacccagcaattgcactcttgtgtatttatctgagagtgatgaaaacttatgttccaacaaaaacctgtacatgaatgtttgtagcaactttattggtgggcccaaactggcaacatcctgaatgttctgcaactgtcagtggtgaaattaattgtacacatatatacctagaatcctactcagcaatggaaaggtatgatacatgaaataatctggctgaatctccagggaatttttctgcatcaaagaaaactaatgcacataggtcacaagtgaatacctttatataagattcttgacatgac

SEQ ID NO: 55876 - DNA, 316 bp, Homo sapiens
ctgcactgagtgacagagcaagactctgtctccaaaaaagaaaagtatatggaaaggcagaggacctagaatagccaaagcaactttggaacataaattgaaggattaacattaccttatgaaagcttattaaagctgcagtaatcaagagagtgtggtaatagtgtcatggtaggcaaatgatcaatggaccagaatagagtgtccaaaatagactaacatattacgaacaacagatatttgataaagatataaagcagattagtggagaagggtagcattttcaactaaggatgctgaaacagttgaattccat

SEQ ID NO: 55877 - DNA, 229 bp, Homo sapiens
ctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatc

SEQ ID NO: 55878 - DNA, 157 bp, Homo sapiens
agaaacttcaaagttaatgggacggtcggatctcacaggctgagaactcgttcacctccaagcatttcatgaaaaagctgcttcttattaatcatacaaactctcaccatgatgtgaagagtttcacaaatccttcaaaataaaaagtaatgactta

SEQ ID NO: 55879 - DNA, 297 bp, Homo sapiens
  misc_feature 19: n = A,T,C or G
gctgtgtgtttgtttaagnggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgc

SEQ ID NO: 55880 - DNA, 415 bp, Homo sapiens
  misc_feature 18, 24: n = A,T,C or G
tacttcgctcgtactcgngcgccncgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcacctgcctttcccatctgtctatctatctggctggcagggaaggaaagaacttgcatgttggtgaaggaag

SEQ ID NO: 55881 - DNA, 123 bp, Homo sapiens
  misc_feature 25: n = A,T,C or G
tatcagagttaaccacataaattcnattagaaagtcatcttttcaataacccttctcattgaatatgttggttattacagtttgagtgatatgaggtgagttggaattattttacttgctttg

SEQ ID NO: 55882 - DNA, 290 bp, Homo sapiens
cttccttaggagttttgccctcccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaac

SEQ ID NO: 55883 - DNA, 136 bp, Homo sapiens
cacaataaattacatatatttagccggatttttatttgccgtgatatatgggataatttagtctttggcatgtggcattatatttattttggtttttttttttaaacaggttatcaacgaaacttctcagcatcac

SEQ ID NO: 55884 - DNA, 177 bp, Homo sapiens
  misc_feature 177: n = A,T,C or G
cctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttn

SEQ ID NO: 55885 - DNA, 250 bp, Homo sapiens
caggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccatttttttttttt

SEQ ID NO: 55886 - DNA, 294 bp, Homo sapiens
  misc_feature 20, 24, 80, 91, 136, 161, 172, 193, 285: n = A,T,C or G
aagcagtgaagtgtgtggangcancagcaggtacttaactttgaccgaacgctagccaagtgcattataaggtgattgangatgaattgtnccttaatctccatccttcttccatctgcaactgatactatgcggncctttagtgctgatcatatttctgntctaaatactnggcgcacaataggtactcagnaacagttctttgattgggtgaatggatgagtgaatgaagacagaagacaggctttaaacttttttaaagtatggtttagaagaaaaaggagngtagttttg

SEQ ID NO: 55887 - DNA, 335 bp, Homo sapiens
aaatgcaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccg

SEQ ID NO: 55888 - DNA, 232 bp, Homo sapiens
  misc_feature 6: n = A,T,C or G
gaaagncattcggaagaaatctataaaatttaaatacaagataccatagcaacttcttacctgccgtctttcatatgaataatttggacacgacaactttaaaaagataatcaagaaatttaaattcagtctgggtattagatgataccaaggaattgattttgtaaaatatgaaagtggcattgtgggtatataagaaaatatccgtaattttttacatttcataatagtc

SEQ ID NO: 55889 - DNA, 312 bp, Homo sapiens
  misc_feature 21, 277: n = A,T,C or G
aattgtccgaagaagcacagnagttcagaagtactttaacatgggctcttcctctagcagccagtatactttctgtcagccagaaactgtattttcatctcagcctagtgatgatgaatcaagtagtgatgaaaccagtaatcagcccagtcctgcctttagacgacgccgtgctaggaagaagaccgtttctgcttcagaatctgaagaccggctagttggtgaacaagaaactgaaccttctaaggagttgagtaaacgtcagttcagtagtggnctcaataaggggggttatactttgcttttggggat

SEQ ID NO: 55890 - DNA, 201 bp, Homo sapiens
  misc_feature 6, 30, 148: n = A,T,C or G
cttctngcttagtctgttttctaaagccgnactattccctttcctccccaggaatatgtgttttcctttgtcttaatcgatctggtaggggagaaatggcgaatgtcatacacatgagatggtatatccttgcgatgtacagtatcangaaggtggtttgacagcatcataaacaggctgactggcaggaatgaaaacaag

SEQ ID NO: 55891 - DNA, 180 bp, Homo sapiens
gcagccttactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttc

SEQ ID NO: 55892 - DNA, 459 bp, Homo sapiens
  misc_feature 6, 30, 31: n = A,T,C or G
tattgncagtgctcggaatgtgaccaggcnnggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatct

SEQ ID NO: 55893 - DNA, 197 bp, Homo sapiens
ctgccaaatgagctattgccctcacttgatatgcaaacactggctgtctagtatggaaaaatatttttctggctgtagacttgagtttgattaccaaattgatttctgtgaattacatttcaattctgtgcagaactttttgacagccctttaatcaccatgtatccaataaatatttattaaagacatattctgtg

SEQ ID NO: 55894 - DNA, 385 bp, Homo sapiens
  misc_feature 6, 21, 23: n = A,T,C or G
cattgngaaaattactcaaananctaaaagtcagaactaccatatgacccagcaatcccattacttggtatatatatataccaagaggaatataaagcattctatcctaaagacacatgcactcaaatgttcattgcagcactgttcacaatagcaaagacatggaatcaatctaaatgtccatcaatgacacactggataaagaaaatgtggtacatgtgcaccatggaatattatgcagccataaaaaagaacaagatcatgtcttttgtgggaacatgaacgaagctggaggctatcatccttagcaaactaatgcataaacagaaaaccaaatactgcatgtcctcacttattagtgggagctaaatgataagaacttatg

SEQ ID NO: 55895 - DNA, 476 bp, Homo sapiens
atatgagggtcctaaaaaatcttccttttttccctttaatctagataactattattttaagcatcacactaaattaacttgatgattacaaatacaaatatttccacatggcaacacattctaaaattcattaaaaactatttcatgaaaatgattatattttagaaagtaaactatatctcaaagtgcttcaagaaataatagaatataattaatttgcagatatttatcaaccccataggtaaacacataaacatcaggtccataaaaatgcacacagcattttaaattaaagaaatatgctacatttagattttatcagcaacttaaaaaaattaaaataacttttattgtgtatttgaggggaaggctttcttcacatttgaacataacacaaaatgttaactaaatttattttattcctttttccaaccctttaaagaactgaggtagctttaagttccgtctttcaaaat

SEQ ID NO: 55896 - DNA, 385 bp, Homo sapiens
  misc_feature 7, 25: n = A,T,C or G
tatggcnagggtgggcttcaatgtnaagaatgtgtctgttaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccaccctttgggtcggctttgctgttcgtgatatgagacaga

SEQ ID NO: 55897 - DNA, 239 bp, Homo sapiens
  misc_feature 12, 210, 231: n = A,T,C or G
tatggccggtantccttatgttatagcatcccttgatcttggagttcctatcttctacctgcatcccagaattcttcattaaacctggccaccttctgtacactcttaattaaaagtggaattgattgcattctcaggtattgacattatacagataaaagaggggaagcaagtttttgctaaaatgacctgaatttttttattctgctnatgaacaagccaaacactctnctaaagct

SEQ ID NO: 55898 - DNA, 464 bp, Homo sapiens
  misc_feature 5, 31: n = A,T,C or G
gtagncgcaacagtgtcataaagtccatgangcctatttttttgagtaatcaatattgtggaaaagtgctagagcagacctaccttatataaattaatttgtttgaattgctctattcactatgaataaatatttattggagtaccttctatatgctggggacctcagccatgagatacgcaggtggaaaaaataacacttaagcagcttattgtatagcagagaggtggttgaattgatagacaattaaaatacaacgtgttgaaaggcctgttaaagccacagggtcactcagtggcaggagggattcagtcagcctgggccagccatggcaagtaagtggcctttggaaagttaccaaggtaagacatacctgatacgttcaagaaacaattccaaggttcaataaggccagaagttaaagggcaaatgtaagcccctggaaactgaggctagaaaggtag

SEQ ID NO: 55899 - DNA, 208 bp, Homo sapiens
  misc_feature 126: n = A,T,C or G
tgtaaatatttctgtaaatactaccaattggaaattagaacagtagagtacttttctgaatccaatcctatttttattttatacagtatttctcagctgtgatctttggagcaaaagccaacggcnggaaaaaatagtttgtaccagtttcatgaagtatgtctttgggtttttgtaaataattttaactcaaataaaattgctactt

SEQ ID NO: 55900 - DNA, 244 bp, Homo sapiens
  misc_feature 7: n = A,T,C or G
aatgtgncatggcaggatctatggaaccaaatggaagattttgaggtgatgtaggtctttcacagctagctttggggaatacggaatactcaaataaagtgctttgttattatttcagagggaatggcgattgaaatgttacaacagagatttcttggtggtagctatttgggtaaaggtatatgggtatttttctgtacatgtgaaattatataaaaataaaagttatataaattacattgac

SEQ ID NO: 55901 - DNA, 367 bp, Homo sapiens
  misc_feature 31: n = A,T,C or G
atagaccaagtcttcagatggctaaaataancatgcgcgtgttaccaaaggatatgtttacacaaaccatttgctcagcctctgaaataatgaataaatgaagattttactaaaataattggggggatttttgtgtttctgcggatgccataattgaatggcaccaaagagacttttatcagctattttccgtgttacatgtgttagcagttcctttctgtgggttgaatacttcattctgtagttactttacacatgtttttctaagaaattgtcgtttattactgcaattctagagagttgcttgatttctcaagagaaatttagcagccagtaaaggttatttggatctggttggtcagggaga

SEQ ID NO: 55902 - DNA, 442 bp, Homo sapiens
  misc_feature 32, 33: n = A,T,C or G
gaaagacgcgtaagcccaggaaagcagaaggnntccccagaagagggccgaatcagcctggccagggatttaaagaggacacacccgttaggcatttggaccctgaagaaatgataagaggagtggatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacat

SEQ ID NO: 55903 - DNA, 339 bp, Homo sapiens
  misc_feature 23, 317: n = A,T,C or G
tcggttggggcgacctcggagcngaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtncgaaaggacaagagaaataagg

SEQ ID NO: 55904 - DNA, 395 bp, Homo sapiens
  misc_feature 30, 41, 333: n = A,T,C or G
aacagcagaaatgcaaataccttcatatcntctcagcaganatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgnctggctgcacccctttttcccgcccccagattgataagtaatgaaagtgcactgcagtgagg

SEQ ID NO: 55905 - DNA, 263 bp, Homo sapiens
  misc_feature 7, 31: n = A,T,C or G
aattttntttgggtgatactagatagttgtnaacattgtgctttgtaataatgccagtatttgcattagatgattcatggatctttttcttttctgtcaagggctgtttgcttcagtggtttagcaattttctctcactgagtacatttttagaggtgtatttgctaattgattgcgtgtttcctctttgaactgaaatgagcaacagaagacacatcttatctatggcagctgtggcacaaatgacatgccgaatgtcaagc

SEQ ID NO: 55906 - DNA, 343 bp, Homo sapiens
gcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgag

SEQ ID NO: 55907 - DNA, 136 bp, Homo sapiens
  misc_feature 7, 124: n = A,T,C or G
gttgacngagcattatattaaaacttgtattaaagaatacagatatgcattgtattagaggctttaggacttttttcaaaacgaaccttgaaaaacttcttcaatttttttttttttaaaagcngttctattaaag

SEQ ID NO: 55908 - DNA, 384 bp, Homo sapiens
  misc_feature 6, 32: n = A,T,C or G
ggcgcnctagtatatagtaccgcaagggaaanttgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 55909 - DNA, 167 bp, Homo sapiens
  misc_feature 135: n = A,T,C or G
caaacagcttcctgaattttgtgtctgtctcacagaaagccttatcataaattccataattctaattaatttaccaagataatgtaattacatttggttttgtaaggtatacaagcagtaatctcctattttggngtcagtttttcaataaagttttgattatgggc

SEQ ID NO: 55910 - DNA, 450 bp, Homo sapiens
aagtctgtgttttcctttccttatcactgaaagcatgcgatagccatccaagtggaggggaaagggccatccctttgatcttcagtttagtgggaagacacagtcataacctatttgccataatcaaaggttttctgttagttttctggttgaatcagtcggtgtagagaggaaaaggagttaggtgcttacaatgactttaaaacccattactagtgtgtacttttcccataaaataatttttgattgtatcatttagaggtttcagtgttagtcttcaaatttctagtctgttctgtccataaagaaaagtaatcttcctgccaaatcaatttattcagataaattacttaaaaagaatccataaaagagtaaaatgtacagctaaattctcatacaccaacaatcctaatattttcctgttcatggttcctgctaaggatcttatat

SEQ ID NO: 55911 - DNA, 383 bp, Homo sapiens
  misc_feature 20, 25, 382: n = A,T,C or G
acctcctctcttctcctttngcccnaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgttgcccaaaagacgttttctttggaccaaagatctctttcgng

SEQ ID NO: 55912 - DNA, 489 bp, Homo sapiens
  misc_feature 8, 32: n = A,T,C or G
atattacnaaaaacttggatgtatcagtgtantcttaattttttattttcatactggccttgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaataga

SEQ ID NO: 55913 - DNA, 110 bp, Homo sapiens
  misc_feature 41: n = A,T,C or G
ctaggctgctgacaccaaggccctgaatctgtctgctctgnatatatgtctctttggagttggaatttcattatatgttaagaaaataaaggaaaatgacttgtaaggtc

SEQ ID NO: 55914 - DNA, 228 bp, Homo sapiens
  misc_feature 224, 227: n = A,T,C or G
cccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcanacng

SEQ ID NO: 55915 - DNA, 342 bp, Homo sapiens
ggaaagcacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgtaatcaggctgaacatttctacaattactagatgtattagacgtaagtattttctttagttaaaccacccatgttagaaatgttttctgtagaatttataaacaactatcaatgcagac

SEQ ID NO: 55916 - DNA, 373 bp, Homo sapiens
  misc_feature 13: n = A,T,C or G
aagatttattatnaaggggcaatatttttatcttttccaaaataaatttgcaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcat

SEQ ID NO: 55917 - DNA, 450 bp, Homo sapiens
  misc_feature 24, 389, 440: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatggcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngattaaaataatttgaaggcgatcttttaaaaagagattaaacccgaaggngattaaaaga

SEQ ID NO: 55918 - DNA, 481 bp, Homo sapiens
  misc_feature 41: n = A,T,C or G
tatggccgggcaacaacctaagtatacaagaaacttacttnttcactgtaaaggctgtatatgaaaaacctatatctaatattataatcaatggggaaaaactgaaagctttttcttaatatctggaacaagacaaggatgtctactctcatcactcctattcaacatagtactggaaatcctagccagagcaatcaggcaagagaaataaaaggcatcaaaattgaaaggaaagatgtagttacctctgttaacagaaaacatgattattatacattgaaaaccgtaaagactccacagaaaatggttacaaataatatagtcagtctttcatatctgctggggatttgtttcaggaccccctcagataacaaaatctgtgatgatcaactccctcacataaaatcatgtacagttggccctatgtatccatgggtacacatctgtggattcaaaccaccacagatggaaaatgtgtaca

SEQ ID NO: 55919 - DNA, 351 bp, Homo sapiens
caaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccat

SEQ ID NO: 55920 - DNA, 418 bp, Homo sapiens
  misc_feature 4, 30, 408: n = A,T,C or G
aaanggccagtatctttaattccccttgantttgtgattaaaaaatacaaccctgttgagtacttttgagaagaattgaattttatcttgagcatgtctttctatactcagtttaatttgtttttataaaatatacaatttattaacttgtttaatattcactataccaaagaggtatctaatacccatgggttatgtagtcatgatggggatacaaatactttcttgcactattttagtatagattatatatttgagcatatttgaatatgcactaagcaacttaaaaaattcatttgcagatcacgattaagtcttagaattatttttctaacttcctaatttttgagtaggttgtattttggtagacagcatattgtaattgtatgtaaatttgtacacaattgngtgtaaattg

SEQ ID NO: 55921 - DNA, 369 bp, Homo sapiens
  misc_feature 25: n = A,T,C or G
gaagtattcaataccgctcagtatnttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttg

SEQ ID NO: 55922 - DNA, 341 bp, Homo sapiens
caccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatg

SEQ ID NO: 55923 - DNA, 117 bp, Homo sapiens
  misc_feature 19, 25, 115: n = A,T,C or G
acccccatcgtctcattcncaggcnaaactaaacacaagatcaactccccttgcaagttgaagtcctgacattgaagtctaaagaaattacagcccacaataaaattcttaaagngt

SEQ ID NO: 55924 - DNA, 471 bp, Homo sapiens
  misc_feature 1: n = A,T,C or G
naagcccccgtagcctttccttttacacagttttttttagggaaaaactaaagctattacgaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagtcgttaacaaagcatagtcgatgtttttaaatcaaacataatttgtatcttggaac

SEQ ID NO: 55925 - DNA, 276 bp, Homo sapiens
aacttactccttcctgattgaaccacacaactcactgtgaggggaatatctattctgaaccacagttttaggaatgtggaaagggccaacagcgggccagactaaatgggcagtgggtgtttatgctgccggtgctgtctgggaaagggacctctggtgatcatctcactggttgggccaggttctttcctgaccttgcgaagagtctgtgagaaaaggagaattttatttatttatttagaaatctgagaaaaaggtcgacatctaggtaggagg

SEQ ID NO: 55926 - DNA, 490 bp, Homo sapiens
  misc_feature 6, 29: n = A,T,C or G
cagatnctggaggataaccagcaggagcntagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataaga

SEQ ID NO: 55927 - DNA, 328 bp, Homo sapiens
  misc_feature 27, 327: n = A,T,C or G
aacacttcaagtgcttgagagcctgcntgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactgcccttagagatagagaaacagacccaagaaatgtgctcaattgcaatgggccacatacctagatctccagatgtcatttcccctctcttattttaagttatgttaagattactaaaacaataagagctcnt

SEQ ID NO: 55928 - DNA, 450 bp, Homo sapiens
tgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaaga

SEQ ID NO: 55929 - DNA, 354 bp, Homo sapiens
ccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgc

SEQ ID NO: 55930 - DNA, 100 bp, Homo sapiens
  misc_feature 4, 5, 6, 7, 9, 47: n = A,T,C or G
atgnnnntngcctggaggacaatcaagaagacgctctggaagcattnacgctaactcctactttatggctgagaatggcccgggaagctttctgaacacc

SEQ ID NO: 55931 - DNA, 250 bp, Homo sapiens
  misc_feature 19, 37, 49, 50, 57, 73, 80, 98, 149, 152, 169, 189, 190,197, 203, 227, 247: n = A,T,C or G
atacctgcctggagaatgnatctttcttactgaactntacaggctgtgnngcgtgcngtaacgcgggattttntgctgancacaaacaaatccttganagaagaagatggagatgaaatagagacctatgatcatttgtgtagagaatngtnatcatgtgaatagccanacgtgagtatacatctcagnntcatggntgaatntcaggagtataccatgctgagtcngttatgcaggcaaagccganaga

SEQ ID NO: 55932 - DNA, 427 bp, Homo sapiens
  misc_feature 28, 38, 51, 59, 60, 65, 86, 207, 211, 244, 271, 293, 383: n = A,T,C or G
ggttaaccgaataagcgtacacggtggntgtttaggcnatcagtaggcgangaaggacnngctantctgcgaaaagcgtcggtaangtgatatgaaccgttatacccgacgatatccgaatggggaaacccagtatccaatggatactatcattaactgaatccataggttaatgaggcgaaccgggagaactgaaacatctcagtncccngaggaaaagaaatcaaccgagattcccctagtngcggcgagcgaacggggagcagcccancagtcttaatcaatagcagtgncaggagaacggtcctggaaagtccggcagtaaagggtgatagccccgtatctgaagatgctgttattgtgaactcgatgagtagggcggnacacgtgttatcctgtctgaatatggggggaccatcctccaagg

SEQ ID NO: 55933 - DNA, 293 bp, Homo sapiens
  misc_feature 26, 37: n = A,T,C or G
aaacagtgggaagtaacttggtagcngcactggggtnttgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgc

SEQ ID NO: 55934 - DNA, 270 bp, Homo sapiens
  misc_feature 6, 32, 33: n = A,T,C or G
ggatcnccgttactgtgatattttaaatatcnncagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 55935 - DNA, 270 bp, Homo sapiens
aaaatgacctcaatctaaattaaaaaagaaagtatatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaag

SEQ ID NO: 55936 - DNA, 458 bp, Homo sapiens
  misc_feature 38: n = A,T,C or G
tatggccgcccctacagccccccttgtgaagcccaagnatcgtttttaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaggcaacaacaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactg

SEQ ID NO: 55937 - DNA, 303 bp, Homo sapiens
  misc_feature 11: n = A,T,C or G
ccggacccagnaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagc

SEQ ID NO: 55938 - DNA, 461 bp, Homo sapiens
  misc_feature 24, 30, 36, 37: n = A,T,C or G
gaagaaaacaaaatcctttacagnacaagncaaatnntgagagattttgtcaccaccaggcctgccctaaaagagctcctgaaggaagcactaaacatggagaggaacaaccggtaccagccactgcaaaaacataccaaattgtaaagaccatcgacactacaaagaaactgcatcaactaacggacaaaataactagctagcatcataatgacaggatcagattcacacataacaatattaaccttaaatgtaaatgggctaaatgccccagttaaaagacacagactggcaaattggatagagtcaagacccattggtatgctgtattcaggagacccatctcatgtgcaaagacacatataggctcaaaagtaaaaggatggaggaatatttaccaagcaaatggaaagcagaaagaagcaggagttccaatcctagtctctgataaaacagacttt

SEQ ID NO: 55939 - DNA, 490 bp, Homo sapiens
  misc_feature 30, 31, 33: n = A,T,C or G
gaacatcttaggccacaaaacaagtctttnntntatttaagaagcttgacatcgtattgagtatgttttatggacaaaatggtataaattagaaatccacaagaaggaaaacttcagaaactttacaaatacatagaaattaaacaatatgctcctaaataaccaatcggtcaatgaagaagttaggagggaaatttaaaaattttttgaggcaaatgagaatggaaacatatcacaccaaaacctatgggacacagcaaaagcagttctgagaggaagtttatagcaataaatacctacatcaaaaaaagaagaaagattttaataaacaacataatgatgcacctgaagaaactagtaaagcaagaatgaactcaacctaaaattggtaggagaaaggaagtaataaagctcagagcagaaataaacaaaatagagactgaaaaaaaaaacaattcaaaaggtcaatgaaacaaatagtcattttttt

SEQ ID NO: 55940 - DNA, 489 bp, Homo sapiens
  misc_feature 6, 30, 32, 57: n = A,T,C or G
aatttncaaaggaggcagggtggaaagtgntntattttctgaaatggtttttaatanctgagtaactatagtgacctatagtgacatgtgtattcattataaagagctttttttaaaaaagagacaaaagtgaagaaatataagccagatgttttaacaagcatctaaactatatgagtaattctagattcaattatactaagcaattagttagtactatcataagtgaccacaaaccgtgaagagaacaggttatctcaatgcaaatctctgtagagctgggagttatcttgatgcaaatatgtagagctgggcatacttgctaacttagttatagtcttttagagatttaaatatgaatatgatatgtataaacacatgtaaatgttcaataattacaaaatattagaagctataagatgaaatggaggtcatcactgcagtgaatgaaatgccagcggcatcagaaaaggtcaattctccgaatct

SEQ ID NO: 55941 - DNA, 115 bp, Homo sapiens
  misc_feature 25: n = A,T,C or G
catccaccttcagatgtgtctacgngcgctctgccattcaactcggaaactataagtaattctcaagaaagccctcatttttataacctggcaaaatcttgttaatgtcattgct

SEQ ID NO: 55942 - DNA, 350 bp, Homo sapiens
  misc_feature 2, 8, 33: n = A,T,C or G
gntatccntaaaggtaaattgcacttttaaatnaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactg

SEQ ID NO: 55943 - DNA, 263 bp, Homo sapiens
ctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgac

SEQ ID NO: 55944 - DNA, 462 bp, Homo sapiens
  misc_feature 7, 30: n = A,T,C or G
gctgacngaagttgtttgtatacataaagnttatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctat

SEQ ID NO: 55945 - DNA, 306 bp, Homo sapiens
  misc_feature 7, 23, 29, 30: n = A,T,C or G
agactcngtaaatccccatcagnataaannatttttatcatacctcttcctaaatagatagattaaataataaaaatagagaaaaagatttttataagtgattttaaaattctcaatttatctatagatggtgtagaacttgaacctaataagcaaatagtactaattattttcaatcatacttggagcattgacaaaaattgaccatgcattatgccacaaagggaatctcaatgaagagaaaaaaggcaaagattttatagtacattctgcttgccacaatgcattaaaattagaaattaacat

SEQ ID NO: 55946 - DNA, 404 bp, Homo sapiens
  misc_feature 26: n = A,T,C or G
atgtctcgctccgtggccttagctgngctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 55947 - DNA, 383 bp, Homo sapiens
  misc_feature 8, 30, 32, 380: n = A,T,C or G
gaacggcnagctgatcaagaacaatgcctntnctgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttatttncca

SEQ ID NO: 55948 - DNA, 378 bp, Homo sapiens
  misc_feature 377: n = A,T,C or G
aaaaaggactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgttcaaaactaatttcttaaaataaagccttcagtaaatgttcattaccaacttgataaatgctactcataagagctggtttggggctatagcatatgctttttttttttaattattacctgatttaaaaatctctgtaaaaacgtgtagng

SEQ ID NO: 55949 - DNA, 442 bp, Homo sapiens
  misc_feature 2, 28, 30, 31: n = A,T,C or G
gnttcctttccacttggacgctgcagantnnctcccgcaaagaagggtggcgagaagaaaaagggccgttctgccatcagcgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 55950 - DNA, 352 bp, Homo sapiens
ctatcagatattcattgtcctgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaact

SEQ ID NO: 55951 - DNA, 490 bp, Homo sapiens
  misc_feature 15, 33: n = A,T,C or G
aacaaaccaccaagnaataattgtgtgttcttntcaaaaactaaggtagaataattagccagatttattatgaagatattacaatagtatagcattggcatagagatgaagaaaaaaaatagaaaagaatagagagcctgcaaagagatccacacagatccagacttttggccccgtagatgaggcagaaagagtgaacctttcaatgaacagtgctataattaggaatccatattttaaaaaaactacagttgtattcctagttcactatgcccaaaactcatttaaacttaaaaatttatacaactctttgaagataatatagaaaaatctctttgtggaatttgggtaaacaattttttttactcatggtacaaatagtattaatcataaaaaagattaataactttgactactttaaaattaagaagttgtgtttattaaaatacaccacaagaagagtgaaaattggcccagagtgggaaaagct

SEQ ID NO: 55952 - DNA, 425 bp, Homo sapiens
  misc_feature 11, 14, 27, 408: n = A,T,C or G
gcacattgccnggnctgcttcgaagtnttcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcaggttgataagaggaatttggtataattatggggggngattattttttatactg

SEQ ID NO: 55953 - DNA, 494 bp, Homo sapiens
  misc_feature 24, 35, 55, 64: n = A,T,C or G
aaccagaaactttttttttttttnccgggggtttnccctaacaaggagcaaattntttcttagnttctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacattggggaatggagcaaaacagtctttgaatatcgaacacgcaagg

SEQ ID NO: 55954 - DNA, 224 bp, Homo sapiens
  misc_feature 7, 8: n = A,T,C or G
gaaacgnngagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaac

SEQ ID NO: 55955 - DNA, 479 bp, Homo sapiens
  misc_feature 1, 8, 11, 14, 34, 40: n = A,T,C or G
ngaaaatnaanaanccatttttttttaaactttnttgctncctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgccattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatattgaagtaaagttctatgaagtatgcattttgtgtaactaatgtaaaaacacaaattttataaaattgtacagttttttaaaaactactcacaacta

SEQ ID NO: 55956 - DNA, 485 bp, Homo sapiens
  misc_feature 1, 9: n = A,T,C or G
nttttactncctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatac

SEQ ID NO: 55957 - DNA, 500 bp, Homo sapiens
  misc_feature 4, 5, 35, 36, 42, 49, 60, 62, 71, 72, 73, 79, 333, 388: n = A,T,C or G
aaannctttttctttttttttcgggaaaaaaaaannaatttntgtaaantttaatttttntnttacacaannncagctngctccaggcggtaaaccatacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagactccttcanagtttagttttataataaaaactgtttgaataattagacctttacattcctgaanataaacatgtaatcttttatcttattttgctcaataaaattgttcagaagatcaaagtggtaaagacaatgtaaaatttaacattttaatactgatgttggacactgtttta

SEQ ID NO: 55958 - DNA, 218 bp, Homo sapiens
  misc_feature 12, 34, 37: n = A,T,C or G
taaaccccctanacatttaaggtcatttttttcnttnccgtactaaaacactgaaaaatattccaagccttcatattaaccctacctgtcaacgtaacgatttcatgaacgttattatattgtcgaattcctactgacaacattataactgtatgggagcttaactttataaggaaatgtattttgacactggtatcttattaaagtattctgatctt

SEQ ID NO: 55959 - DNA, 191 bp, Homo sapiens
  misc_feature 12, 18, 30, 31, 35, 52, 55, 67: n = A,T,C or G
aaccccggttantttttntttttggccggnnaagntttggaaaaaaattaanttntcaaaaaaaaancttctctttttttgctgttccaccaaatacaattcaaatgctttttgttttatttttttaccaattccaatttcaaaatgtctcaatggtgctataataaataaacttcaacactctttatgat

SEQ ID NO: 55960 - DNA, 198 bp, Homo sapiens
  misc_feature 5, 16, 29, 35, 41, 49, 59: n = A,T,C or G
cctcnttttttttttncgggcttaagcanaaaacnaacttntcttgtcnttttttaagnccaaatagtatttttgttgtcaaactttaaaatttatattaatttgcaaatgtatgtctctgagtaggacttggacctttcctgagatttattttatccgtgatgtattttttttaattcttttgatacagagaagggt

SEQ ID NO: 55961 - DNA, 410 bp, Homo sapiens
  misc_feature 6, 9, 31, 33, 48, 50: n = A,T,C or G
aaaatnttncaaaaaaaaaggatctttttantntgttccggcctgagngnggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggg

SEQ ID NO: 55962 - DNA, 269 bp, Homo sapiens
  misc_feature 6, 14, 30, 49, 50, 52, 62, 65: n = A,T,C or G
aacttntttttttnttttccggggctgccnttgaaatctttttggcctnntncttcgggatntcnaagctgtgtctgagatctggatctgcccatcactttggctagtgacagggctaattaatttgctttatacattttcttttactttccttttttcctttctggaggcatcacatgctggtgctgtgtcttttatgaatgttttaaccattttcatggtggaagaattttatatttatgcagttgtacaattttatttttttctgc

SEQ ID NO: 55963 - DNA, 500 bp, Homo sapiens
  misc_feature 3, 8, 34, 42, 52, 72, 73, 76, 80, 88, 89, 92: n = A,T,C or G
acnccctnttaatttaaaaacccctttttttttnttcggganaaaaaaagcnttttttttttacgtacattnnttntttncaactcgnncgnacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggatttttttttccatgtaagtgaacataaaaacatct

SEQ ID NO: 55964 - DNA, 497 bp, Homo sapiens
  misc_feature 9, 16, 47, 61, 67, 79: n = A,T,C or G
ctttttctnttgggancccccttcttttttttcgggggaggcccccnccccaggggccttnttcttntttggagccggnccgggaaaccgcagcataagtttttttctctttgaaagatagagattaatacaactacttaaaaaatatagtcaataggttactaagatattgcttagcgttaagtttttaacgtaattttaataacttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaagg

SEQ ID NO: 55965 - DNA, 127 bp, Homo sapiens
gcttcaccctggcttctggaggccggccttagagaaaaggcccatctaggtcagaccaggaaatgtggtattgaagacacccagcagtccagggcctcaggtagacggagatgtcccagatgtttct

SEQ ID NO: 55966 - DNA, 464 bp, Homo sapiens
  misc_feature 9, 33, 37: n = A,T,C or G
gggaaaaanaacccccttttaataaaacccttntttntttttttaagctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccat

SEQ ID NO: 55967 - DNA, 397 bp, Homo sapiens
  misc_feature 3, 12, 17, 23, 29, 56: n = A,T,C or G
ggnaaaaaaaanaaggngttgtntgtttntttaaaactttttttcaaaaaaagctnggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 55968 - DNA, 498 bp, Homo sapiens
  misc_feature 6, 10, 29, 35, 37: n = A,T,C or G
aaaagnttcntttttttttaaaacttttntttaananaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactattt

SEQ ID NO: 55969 - DNA, 440 bp, Homo sapiens
  misc_feature 11, 14, 25, 34, 47, 63, 64, 68, 79, 81: n = A,T,C or G
ctttttacaanctnaaccccgctcnccccccccnctgggggattggnaccaacgggggaaaannttcnttaaacaagtnanctcgagccgatcaggcttggtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacagagtaattattctactcttctttttacataaatgtttatttaaatattct

SEQ ID NO: 55970 - DNA, 473 bp, Homo sapiens
  misc_feature 5, 20: n = A,T,C or G
caaanttttttttatttaantgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatggaagatttata

SEQ ID NO: 55971 - DNA, 362 bp, Homo sapiens
  misc_feature 3, 4, 34, 51, 90: n = A,T,C or G
ctnnaacccaaaaccccctttttttttccggganaaacaaatggaaaaaanaatggacccttttttcctatatctatttaacattttttnatctaccaatatatccccaataaataaatataaaagggggggagggtcaatctggggaatcttagtttttcatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtg

SEQ ID NO: 55972 - DNA, 237 bp, Homo sapiens
  misc_feature 15, 24, 27, 31, 37, 38, 67, 237: n = A,T,C or G
cggagtccccccctncctttttcnaanaatntttaanntagaaaatctttctcttacctgtattatnatttttcccagtatttttatacggaaaaaaattgtattgaaaacacttagtatgcagttgataagaggaatttggtataattatggtgggtgattattttttatactgtatgtgccaaagctttactactgtggaaagacaactgttttaataaaagatttacattccan

SEQ ID NO: 55973 - DNA, 309 bp, Homo sapiens
  misc_feature 9, 27, 30, 38, 50, 52, 53, 63: n = A,T,C or G
ccccttccntttttttttttggggggnggnaaaccttnttgatgtgttgngnnttgggaaacncttacgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaaga

SEQ ID NO: 55974 - DNA, 356 bp, Homo sapiens
  misc_feature 4, 19, 29, 51, 355: n = A,T,C or G
cttnttgcggggaatttcncctttgaatnggggggctttacagatctttgnggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaant

SEQ ID NO: 55975 - DNA, 497 bp, Homo sapiens
  misc_feature 16: n = A,T,C or G
tccttttaattgttancttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaac

SEQ ID NO: 55976 - DNA, 330 bp, Homo sapiens
  misc_feature 2: n = A,T,C or G
anaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctga

SEQ ID NO: 55977 - DNA, 409 bp, Homo sapiens
  misc_feature 26, 27: n = A,T,C or G
aagaaaagtatttttttttttttaanngcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaac

SEQ ID NO: 55978 - DNA, 452 bp, Homo sapiens
  misc_feature 3, 8, 29, 40, 54, 65, 70, 72, 74, 76: n = A,T,C or G
gcnccctnaccggaacccccccttttttntttcggggggnaaaacccggggatncaaaaactggnttttntntnanaccgctaacttttgtatcctataggctgcttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtatttgtttg

SEQ ID NO: 55979 - DNA, 277 bp, Homo sapiens
  misc_feature 5, 16, 25, 27, 31, 45, 54, 68, 74: n = A,T,C or G
ctttnataccggaaanccccctttntntttntttcggggggaatnaaatttttnaaattcagcttttntttttnaacccccgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaag

SEQ ID NO: 55980 - DNA, 243 bp, Homo sapiens
  misc_feature 7, 10: n = A,T,C or G
tacaggnaangcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccca

SEQ ID NO: 55981 - DNA, 454 bp, Homo sapiens
  misc_feature 2, 4, 41, 52, 60: n = A,T,C or G
ancncccctttttttttttccgggattcccccaacttaaanattttgcccanattttttncttcccgcttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 55982 - DNA, 467 bp, Homo sapiens
  misc_feature 5, 23, 28, 35, 47, 466: n = A,T,C or G
aaacntttaaaaatttggtatcnttggnctttttnaaaacggaaatngaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattttagtggtgctaatgagcactactgtaatataaagccaccattattttttatcaaacnt

SEQ ID NO: 55983 - DNA, 114 bp, Homo sapiens
tttgggagcgtgtgagtaaaaccatgaggacataatccagctgtcagagctgagtggcaagtgtaaggcaggaaggtagcgtcagggcatagagatctctccttccagatgagt

SEQ ID NO: 55984 - DNA, 191 bp, Homo sapiens
  misc_feature 5, 26, 33, 35, 38, 41: n = A,T,C or G
ccggnaaaaaaaaaaaatctcggtgngttggcnanttnttntttgcttgctccacatgtttttagattgtttcccatggtcccattttagaaatctcgctttatggcatctttaaattttgccttctactgagttatcctaagcatcattcaaacattctacttaaaggaaaataattttccttttcttca

SEQ ID NO: 55985 - DNA, 430 bp, Homo sapiens
  misc_feature 4, 20: n = A,T,C or G
aacnaaaactttatcttttnaaaatgaaagaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcaccgtgcaggaac

SEQ ID NO: 55986 - DNA, 396 bp, Homo sapiens
  misc_feature 2, 26, 28, 42, 44, 58, 69, 72, 81, 86: n = A,T,C or G
ancctttttaacccaaaaaactcccntnttttttttccgggnanccaaagtttcaacnctgctcggctnagnaatgggtcnttttntcgatcctcaagcagcttcctttgacttactacttctttttgtttgttttttcttcattgggctttaagcgttgcttctctttagtgtatgtgtgactgaagccaaacacaacattgctttccctttgcctgcaaataatcttgttgcccaagcccatctctgccattttcagtgacagctggctggccaatgagcctgagcactgggaatgcccagcagggcacatctagggggctgctttatatttggagctagcaggtctcttttctagggctttccaggaaagatttagaattaaacattggatgg

SEQ ID NO: 55987 - DNA, 468 bp, Homo sapiens
  misc_feature 3, 15, 36, 45, 47, 54, 65, 455: n = A,T,C or G
ccnggacccccttcntcttttcgggaggtcactatntttaattcncnacttttntcttaagactnattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggntttggcggggaga

SEQ ID NO: 55988 - DNA, 269 bp, Homo sapiens
tataatttgcccgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 55989 - DNA, 329 bp, Homo sapiens
  misc_feature 5, 12: n = A,T,C or G
cgtanaagtatnaatcgccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgaga

SEQ ID NO: 55990 - DNA, 395 bp, Homo sapiens
aacaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaaga

SEQ ID NO: 55991 - DNA, 268 bp, Homo sapiens
  misc_feature 5, 26, 27, 41, 43: n = A,T,C or G
ccggnatcctccaaaaagtccttctnntgataatttttaancntcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaattattctggctttttc

SEQ ID NO: 55992 - DNA, 385 bp, Homo sapiens
  misc_feature 4, 9: n = A,T,C or G
cacntgacntaccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgc

SEQ ID NO: 55993 - DNA, 159 bp, Homo sapiens
  misc_feature 2, 3: n = A,T,C or G
cnnaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 55994 - DNA, 453 bp, Homo sapiens
  misc_feature 26, 33, 62, 249, 423: n = A,T,C or G
cccgggcaaccctccaaattattaanattaatntttttttttaatacgatgagatgatgacnatgaaatggtgagatgaaatgatgagatgaaatgaaatagtgaaatgaaattgaaataaaatcgaaatgagatgaaatgatgagatgatgaaataaaatgatgaaatgagatgtgatgagatgaaatgatgacatgaaatgatgagatgagatgagatgacatgaaataatgaaatgaaattgaaangagataagatacgagatgagatgaaatgatgagatgaaatgatgaaatgatgagataagatgaaaagggttgagatgatgagatgaaatgagatgaaaagatgaaatgatgagatgaaatgaaatgatgagatgaaatgaggtgaaatgaaattagatgaaatgtaatgagatnaaatgaaatgacctaatgaaatgaaataat

SEQ ID NO: 55995 - DNA, 159 bp, Homo sapiens
  misc_feature 1, 64: n = A,T,C or G
nactataactgaactcctcacacccaattggaccaatctatcaccctatagaagaactaatgtnagtataagtaacatgaaaacattctcctccgcataagcctgcgtcagattaaaacactgaactgacaattaacagcccaatatctacaatcaacc

SEQ ID NO: 55996 - DNA, 476 bp, Homo sapiens
  misc_feature 9, 20, 28, 32, 40: n = A,T,C or G
ccccaaggntttaaaaggtntttttttntttnttcttcgncaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttg

SEQ ID NO: 55997 - DNA, 115 bp, Homo sapiens
  misc_feature 110: n = A,T,C or G
cctatgtgcagaggattatcattggcaatggcgttcattccttacgagtggctttactgcagtttatttcttaatctatgcagtacactacttcttttcaaaactgcgtnccggc

SEQ ID NO: 55998 - DNA, 499 bp, Homo sapiens
  misc_feature 3, 481: n = A,T,C or G
ctngaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatntgagattacggagcagcg

SEQ ID NO: 55999 - DNA, 471 bp, Homo sapiens
  misc_feature 2, 469: n = A,T,C or G
tntttcgcctgctgctgctgctgctgttgcggctaggggaaccgtcgtggggaaggatggtgtgcgaagaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataaattaagntt

SEQ ID NO: 56000 - DNA, 350 bp, Homo sapiens
  misc_feature 16: n = A,T,C or G
actaaagcaaaacaanccaaaacccaaacacccaaaatttaaaatacagtaaaacaactatttacatagcatttacattgtattaggtattgtaagtaatctagagatgttcaagccaggcagatctgaatgcaaattttgtttaattttgttaaatttggacacacattaacttactggtcatagagaaatgattcatctttctgagctcaatttaatggagtcatagagttgttgtaaagattgagataatgtatttaaagtttctagtactgtgactcatacaatgtggaagtaaaatagttgttggatattatatgggaagtatagcaaactgtgacctgagaatg

SEQ ID NO: 56001 - DNA, 312 bp, Homo sapiens
atgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggctgccgtggccgcaccgtgggtgtgtccaagaagaaataagtctgtaggccttgtctgttaataaatagtttatata

SEQ ID NO: 56002 - DNA, 458 bp, Homo sapiens
cacgcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaatttacctttcattttaagga

SEQ ID NO: 56003 - DNA, 161 bp, Homo sapiens
  misc_feature 3, 32, 33, 161: n = A,T,C or G
ctnaatactttttttttcttaattgcatttgnnggctctattttaatttttttcttttaaaataaacagctgggaccatcccaaaagacaagccatgcatacaactttggtcatgtatctctgcaaagcatcaaattaaatgcacgcttttgtcatgtctn

SEQ ID NO: 56004 - DNA, 498 bp, Homo sapiens
  misc_feature 7, 11, 29, 34, 37, 38, 39, 42, 44: n = A,T,C or G
cggaatntttnccctttaattccaaaatnttttnccnnnggncnggagctgccgattccttccagcttttggagtttctctcgtaccgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgcgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaata

SEQ ID NO: 56005 - DNA, 465 bp, Homo sapiens
  misc_feature 18, 24, 27, 31, 33, 46, 55, 60, 71, 86, 104, 105, 106: n = A,T,C or G
acttaaccttttataccnaaaacnccncttncntttcttttttttngggaaaaanaatantaaaacatacntacctcttttttttntaaaaaaaaaaaagaacnnnggggaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggtttttt

SEQ ID NO: 56006 - DNA, 384 bp, Homo sapiens
  misc_feature 16, 28, 32, 54, 62, 96, 97, 98, 99: n = A,T,C or G
acttaactttttttcncgggcctctctnttcntttttttttgggggaaacggcncctccatnttttttttttttcccttttttttaacacagacgnnnnaaaagaggcaaaagtagaggagaacaaaggaaggagaaagtaacttgtggaatgctgagaaaggtaaaaacacttaaataaggaagaggaacaggctatgacctaatgtgtgcttggaccagtataagcatgccagggcaaatatttaggagcacaagtctttgaataaattttgcttttaagagaagttattatttatttttaattagatggggaggaaagtctttgaagaggaagctctactttactttttacacttatcaaattgtactagtcctatttggc

SEQ ID NO: 56007 - DNA, 387 bp, Homo sapiens
  misc_feature 26, 52: n = A,T,C or G
tacacatttagaagaatagatttatnaacaacagtctgcaaaactttgactntggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatatttagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataagggtag

SEQ ID NO: 56008 - DNA, 101 bp, Homo sapiens
ccaccaaccctctctgaagtggaagtggactgacatgctcttctgacatcggactcaaggcgggacaagttgcaaagtgtgcagctgtaactgctccgcca

SEQ ID NO: 56009 - DNA, 345 bp, Homo sapiens
  misc_feature 7, 9, 33, 40, 188: n = A,T,C or G
atttttntnaaaacaactttttttttttcaaantttattnggcaactcaaaatatttaaaataaagtttacattgtagttattttcaaatctttgcttgataagtattaagaaatattggacttgctgccgtaatttaaagctctgttgattttgtttccgtttggatttttgggggaggggagcacntgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagag

SEQ ID NO: 56010 - DNA, 241 bp, Homo sapiens
  misc_feature 2, 3: n = A,T,C or G
gnngggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttc

SEQ ID NO: 56011 - DNA, 307 bp, Homo sapiens
  misc_feature 15, 51: n = A,T,C or G
gccagaggggctaangaccatatcttaggacacagatgtgcccagggaggnggtgtcacctgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacccggcacatagtaaaggctcaataaaaacaagtgcctctcactgggctttg

SEQ ID NO: 56012 - DNA, 497 bp, Homo sapiens
  misc_feature 1, 27, 28, 32, 38, 40, 42: n = A,T,C or G
nggaccccccttttttcttaaaaggtnntttntttttncntngtgccagatgctgcaaggaacaaggaagacagcttatcttttatttagagtaatagctggagaaagaatcactcattcagagagaaaatggactcaaagccaaaattcttcatgcaatgcagtaatctcaaactgtgtaattaatgtcaataaccataaaaaccttatttgtcttaaagtgaaatatgttaggtccttaaaaagacaattgtaaaaccacataataggaatgactccatattctagagaacctgtaaatatcactaaaactctccaaaggtaagctcagtaaaatcttacaaactgccatgagagagacaatagatacaaaaatggaagaatttacatatgaagaattacagatattagagactctctgaaaaacagactttaatcatctacaattttttaataacaataaataaaagcatagaatccataaggcaaaaggtaga

SEQ ID NO: 56013 - DNA, 497 bp, Homo sapiens
  misc_feature 18, 23, 31, 33, 43, 44, 56, 58, 76, 77: n = A,T,C or G
cccccccccccccttggnggaanacaccaananttttgtatgnntttttccctccntncctgttccctacggcgcnnggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttc

SEQ ID NO: 56014 - DNA, 500 bp, Homo sapiens
  misc_feature 12, 25, 35, 41, 43, 45, 46, 47, 50, 51, 392: n = A,T,C or G
gcgggggtttcnaaaaataaaaatntttccacttncctttntnannnttnngttactaagatattgcttagcgttaagtttttaacgtaattttaatagcttaagattttaagagaaaatatgaagacttagaagagtagcatgaggaaggagaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgtcatttaaagcctagttaacgcatttactaaacgcagacgaaaatggaaagattaattggggaagtg

SEQ ID NO: 56015 - DNA, 245 bp, Homo sapiens
  misc_feature 6, 7, 43: n = A,T,C or G
accttnngatgtttggtgggccccacagaggcacctgattgtnacttggagagacagaagcaaatccttccccatgtaattatttttcctttttcccaactctttgtatgtgcatccctccactgtatatcttgtctggcatttttattttccttttgtcctgttaagtgttgttcagctgctgtcatgggctgatccttttgtaaatttaaaaaatttaatgttaataaagcgaggtgtaattg

SEQ ID NO: 56016 - DNA, 500 bp, Homo sapiens
  misc_feature 14, 20, 27, 34, 36, 68, 72, 83: n = A,T,C or G
ctttaccttacccngggccncccctcnccccctntngggaaaaccccccaaccccaaaatttttgctntttngtttttttacntataagcatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattggtatgtagggctg

SEQ ID NO: 56017 - DNA, 496 bp, Homo sapiens
  misc_feature 24, 34, 36, 38, 47, 49, 58, 77, 79, 83, 85, 100, 102: n = A,T,C or G
tactaaaacccaacaggaaccacncccccacccnangngggggaaancnccccaaatnaaggggaattaattttttntntaantnattcacctacacagntntggaggatggatgcacgaaacacactggggaatggagcaaaacagtctttgaatatcgaacacgcaaggctgtgagactacctattgtagatattgcaccctatgacattggtggtcctgatcaagaatttggtgtggaccgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttc

SEQ ID NO: 56018 - DNA, 191 bp, Homo sapiens
  misc_feature 2, 3: n = A,T,C or G
cnnattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatca

SEQ ID NO: 56019 - DNA, 461 bp, Homo sapiens
  misc_feature 2, 6: n = A,T,C or G
tnctanggctaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagt

SEQ ID NO: 56020 - DNA, 409 bp, Homo sapiens
  misc_feature 3, 13, 27, 31, 32, 35, 37: n = A,T,C or G
ccnacttttattntaggcccttttttntttnnaancntcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtact

SEQ ID NO: 56021 - DNA, 474 bp, Homo sapiens
  misc_feature 14, 21, 27: n = A,T,C or G
cttaaacttttttntcttatnggcagngactgagatgtaaaaatagattttagaattaaaacaaaatccaagtcctcacacccctgtcatcccaggagatctttccttgtggtggtttctgtgagaattggccatcctgaggacacagccaggacggcagaggcctcctggcctcagggcatgccctgcctaccttctgaagtgtttaccccattgaccaaacttggctccagccattgcggtggtttctggatagccaggcccaccaagagatattgccccttgatgagagtcaaacaccctgcctacaaggagatgttttgaaatggagaggaaaattggcacctcatcttttaaaggcagtaatggaattgattttcagtaactgaatttgtgcacaaaacattctaaacactagtgaagcctgtttcgttgaactaattaattctggctctggaaatggtttttgtttta

SEQ ID NO: 56022 - DNA, 495 bp, Homo sapiens
  misc_feature 2, 7, 35, 37: n = A,T,C or G
cnccccnaatttttttaaacccctttttttttttntntatgtagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaatcttcagatgcaatggttttgtgtagcatcttgtctatcatgttttgtaaatactggagaagctttgaccaatttgacttagagatggaatgtaacttttgcttac

SEQ ID NO: 56023 - DNA, 500 bp, Homo sapiens
  misc_feature 27, 35, 40, 56, 57, 61, 64, 72, 83, 86, 87, 89, 90, 91: n = A,T,C or G
acataaccttattttgggccccccccntccctttntcggnggatcctccagatttnntaanaanaaaccttntttttccttanttnngnnnttgccttaggtgtacccacccagaaaaggacaaaggcattcctgtagtcattgtgttgtattttagctcttaaactttttaagagattagaataatttgacacatagaagatctaaaccactgaagaggctctgaagcagataaaagtagaaagaaaataaaaaactaattagttacaaattaagcttgaccacaattcgtttaaacgatactatttactcttcacatgattggtttttcttttgctttatagtatgacatagtttatatctttaaaggggaattaaaatatttctgggaatttttaaaagtaagttcacacagccacataaaaactacagaaagagataaaacctatcttctcatttattccctaatccattcaaattaaatataaaaatccaagcat

SEQ ID NO: 56024 - DNA, 184 bp, Homo sapiens
  misc_feature 5, 184: n = A,T,C or G
ctagngataactttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacaaaccan

SEQ ID NO: 56025 - DNA, 433 bp, Homo sapiens
actgttggaatgctatttgtgttttgttgcacgattttttggttgtttatttggttggctttttggaagacaaatttggaaaggggacctacacagaagtgctgacccacccacattcccttattatcattacagacaagaaggaattagcagagctaagaatggagtgaagaaaggcagtgtgataagcaccagcaaagagttgagagctgttgctctctaaattattatttgattattttaaaagtatggaagttttctagtcactgaagaaaggaggggaaagtgcacttatttttatatgggagttacttaactaccacctaaacacatatgtggaaattgtttttgctggtgcaaagtattttaattagcaagaattcatatattgagattataattagagagctcaatttatatatttgctatcctg

SEQ ID NO: 56026 - DNA, 500 bp, Homo sapiens
  misc_feature 2, 4: n = A,T,C or G
angngctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggagcagcagtgttctcacagtgtggggcagccgtccttctaatgaagacaatgatattgacactgtccctctttggcagttgcattagtaactttgaaaggtatatgactgagtgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtat

SEQ ID NO: 56027 - DNA, 115 bp, Homo sapiens
  misc_feature 7, 8: n = A,T,C or G
ctagggnnctgaaatgttctaaatactcttattttgaatgcacaaaatgacttaaaccattcatatcatgtttcctttgcgttcagccaatttcaattaaaatgaactaaattat

SEQ ID NO: 56028 - DNA, 106 bp, Homo sapiens
  misc_feature 5, 8, 21, 25, 31, 33, 35, 44, 51, 60, 78, 87, 89, 94, 97: n = A,T,C or G
ctctnatntcattcttcaacntttnttcctntntntacaatttntactttntataaacanctttatcatttttataanctttccatnanttttnctntaactacta

SEQ ID NO: 56029 - DNA, 183 bp, Homo sapiens
  misc_feature 12, 179, 181: n = A,T,C or G
gtcctcttcttnagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccananga

SEQ ID NO: 56030 - DNA, 100 bp, Homo sapiens
  misc_feature 2, 15, 30, 91, 93: n = A,T,C or G
antggagcgggccanaagatggttggaccnctacatagcaattttctgtggcactgagaaaccatgtatgaccacaataaaaatccatttngngaaaggg

SEQ ID NO: 56031 - DNA, 108 bp, Homo sapiens
atgttttgtataaatttgtcatgttgaacagcattttagcatggtaagttcccttagctatatgaattttggcatgtttcagagagatcagtaaataaaatattagat

SEQ ID NO: 56032 - DNA, 489 bp, Homo sapiens
  misc_feature 5, 6: n = A,T,C or G
taatnnttgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgtttgaagacatctaccagtttctccaaatgccttttttaaaactcatcacagaagattggtgaaaatgctgagtatgacacttttcttcttgcatgcatgtcagctacataaacagttttgtacaatgaaaatactaatttggtttgacattccatgttaaactacggtcatgttcagctt

SEQ ID NO: 56033 - DNA, 470 bp, Homo sapiens
  misc_feature 6: n = A,T,C or G
atagtnacatagaattaatttttaggtaagcttctttattaaagattataacattgcataaagatagtatatcttgcaaaatatatttgtcttacagttgagagaatatggttgtcatgacaatgtttggtttagagcacaagtctgcatgttcttgggtagacgagaattctttcgaacagcacagggtgtgaattatttaagctacttccagttatcaccatatctcatgttacaggtggtttgtataataattgcatgaaaacagtgtttcagaaaagatgtctttctgtgtgacaagatgtcagagaattcatttatttcctctgttttacataaattttatttttttaaaagtgtgaaataataagcttttcaacaaatagagagagtacctagacattaaaaaaatcatgttgagttgtactgtgaatattatgctgcttgctgctgactggtcttgggctgtc

SEQ ID NO: 56034 - DNA, 397 bp, Homo sapiens
  misc_feature 12: n = A,T,C or G
attggccggganggagggataggttcaccttgaggagatagaaaaggcttctcagggaggcaacttgagctgagtctttaaatctgtgtagatatctaccgggttgatgggaatgaaggacagttggggagagggtaggcattctgggcaaacagacagcaagagttgcagggagctgatgaaatttcagggaaattcatgaattttgggtcaggaagagatgagtgatgtggttgcacagaaaacaggagacccatgaggagacgtctttggtgtgctggggagagataataaaggcctgcagcaagcaggggaagcaggaatggagacgggcagggtgggaagacatgcgaaggaagtggagcggtcaggactccattgtttaattggtgatgac

SEQ ID NO: 56035 - DNA, 188 bp, Homo sapiens
cacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttgtaccaactaaaacccccaataaaccttgaacagtg

SEQ ID NO: 56036 - DNA, 474 bp, Homo sapiens
  misc_feature 432, 436: n = A,T,C or G
tggggataaaggctacttaacaaaggaaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgnggtngtttgcatccccttgccctcaataaataaagttctttt

SEQ ID NO: 56037 - DNA, 139 bp, Homo sapiens
ggtttgtgagccttgctgccaagtcctgcctttgggtcgacatagtatggaagtatttgagagagagaacctttccactcccactgccaggattttgtattgccatcgggtgccaaataaatgctcatatttattacca

SEQ ID NO: 56038 - DNA, 500 bp, Homo sapiens
  misc_feature 7, 20, 27, 44: n = A,T,C or G
tcgtttncaaatggcctcantaaagangactttgctaagttaanagagttaaaaatttttttaatataagccaaaatattaactttaatgaaacattgacttggcaaatgaatttcctataaattatcattggtcagaatgctgttttgtttaataatattatgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcactttttaagttcttgaaaatatatgcattctcctaaatattaacaaaaatgatttggggaaatgacatggcttggattgttctgtt

SEQ ID NO: 56039 - DNA, 476 bp, Homo sapiens
attttaatctggggtaagtttggaatggtccttttgctagcaatcaattccaggtaagaaccaattactcatttttaaagtgcgactattaattttaaatgtgctcttgttggcaattaaacatgagattaaggaaagcatttggggaacaaaaacttccaggacctccctgaaaggccagttgcatgagtgattagcatagatatttataggcctcttgcataattgcaatcaaataaaaatgtgattgtacatgccatttccctttgggctttgctagtcataaatcctcttggataatatatttgctgtgcccgggtaactttaaggaaacactgttcaaacagtgagcaaacacctgcatcatgcccttgatattatgtaaaaagtgggatctggccactaccaggttgcttctgacacttcatccctcttggagaaaaaaattcacctaaccccattcttaaatccagaag

SEQ ID NO: 56040 - DNA, 390 bp, Homo sapiens
tgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttaccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaatttt

SEQ ID NO: 56041 - DNA, 280 bp, Homo sapiens
gataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtgg

SEQ ID NO: 56042 - DNA, 423 bp, Homo sapiens
tatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaatttttaaagttcttattttaggtatacgtataaatatcagtattctgacatgtaagaaaatgttacggc

SEQ ID NO: 56043 - DNA, 476 bp, Homo sapiens
ggtaaatgttgatgaaaatgcaattggggttaatattttaagaattctttagtatattcttgggtgtggctatattacaaaatgggatgctggtaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacagagtattgatatgtggtgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcg

SEQ ID NO: 56044 - DNA, 189 bp, Homo sapiens
  misc_feature 1, 13: n = A,T,C or G
natggcgcggganttgaaatggaattttcttaacccagaaggtagtatttataatcttttacttgtagcgaactgtttaaagttaacacttgtttaaatttttttacactatagcatttatgcaatggtttacagaattcatggagttatttttatcagtatgggaattaattaaaaccttgaatctct

SEQ ID NO: 56045 - DNA, 490 bp, Homo sapiens
tatggccggggataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatt

SEQ ID NO: 56046 - DNA, 234 bp, Homo sapiens
  misc_feature 2, 18, 25, 31, 51, 72, 81, 201: n = A,T,C or G
cnggagccgcagacggancttgganaagganaaagctctagttcttaaacnacccgacacctcctacaagangttaagaanaaaagtttaccaacactaatctagtttacagaaaaaatcttgtgctagaaatactttttaaaaggtattttgaatactattaaaactgttttttttttccagcaagtatccaaccaactnggttctgcttcaataaatctttggaaaaactct

SEQ ID NO: 56047 - DNA, 474 bp, Homo sapiens
  misc_feature 11: n = A,T,C or G
aagctgaagangaagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttccttggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgcttaagta

SEQ ID NO: 56048 - DNA, 297 bp, Homo sapiens
taggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcatgggaaccaatatgtacatgtttgcaattatgctgtgagaatttaaatgtgttagatg

SEQ ID NO: 56049 - DNA, 474 bp, Homo sapiens
  misc_feature 13, 417: n = A,T,C or G
acactgatatttnagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcggaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaatttctaagtatcttcatgttctatgactatagaaccatttgngcaaaaaaaaagcttttcttgctacaaaaaataagcaattttcttgagccttattga

SEQ ID NO: 56050 - DNA, 316 bp, Homo sapiens
caggaagctacagtggacgatacctaccaaagtatggtgctagaataaaatcaggaacactcaagccactgaataaaaattatgtacctaaatctaaattagtgctaccaaatttggagggagctggtgatgtgtggtgctgttttccagcttcagtaggagaatcttgccaagtactttttggtttgtttcctgttaattttggaaagaattgagtgttcctatatgcctaagagatgatatgagcagagcagaggttctatacctttttttcccttctttttgaaagagttgtaatacattaatttgtatttgg

SEQ ID NO: 56051 - DNA, 376 bp, Homo sapiens
ggacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaatcctgtcttgttcataaattgacaatgtcaataaattgaaatatggttcactgttactcttg

SEQ ID NO: 56052 - DNA, 500 bp, Homo sapiens
  misc_feature 2, 15, 42: n = A,T,C or G
tntgggcccggggcnttttttcgaggtaggagtcgacctccntgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttc

SEQ ID NO: 56053 - DNA, 407 bp, Homo sapiens
  misc_feature 3, 29: n = A,T,C or G
tantgggccgggggcctgtggaccaaaantaatgaaggaccctggaccagtgtagagatggcaaagtgggcttccagagcttctttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtatttggtttgcatccccttgccctcaataaataaagttcttttttagtt

SEQ ID NO: 56054 - DNA, 492 bp, Homo sapiens
  misc_feature 11, 12, 31, 417: n = A,T,C or G
ggaagcctgannagcatttcgggcccgagangtctcgcttccgtggcttttagcctgtgctcgcgctactctctctttctggcttggaggctattccagcgtactccaaagattcaggtttacctcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaagcagcatatgggaggttttgnaagatgccgcatttggatttggaatgaatttccaaattctgcttgcttgctttttaatatttgatatgccttata

SEQ ID NO: 56055 - DNA, 290 bp, Homo sapiens
  misc_feature 46: n = A,T,C or G
tatggccggggattgtggcatgtttggggtgttattttaatatttnacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgac

SEQ ID NO: 56056 - DNA, 476 bp, Homo sapiens
  misc_feature 382: n = A,T,C or G
atggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattgggtggtcctgatcaagaatttggtgtnggacgttggccctgtttgctttttataaaccaaactctatctgaaatcccaacaaaaaaatttaactccatatgtgttcctcttgttctaatct

SEQ ID NO: 56057 - DNA, 382 bp, Homo sapiens
aacctattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaaagaagagctatcaggagaaagcttggttctgtgaacaagcttcagtaagttatctttgaatatgtagtatcctatatgactatgcgtggctggaaccacattgaagaatgttaga

SEQ ID NO: 56058 - DNA, 497 bp, Homo sapiens
  misc_feature 6, 7, 36, 55, 273: n = A,T,C or G
tcggcnntttattggccgggtgaaagcagctagacnaatgtgaaaatgattcttnaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttnttgtattgggggttttgccatttgttggtctgttgatttccctagatgtgaagtctgttttgttttcaattgtctgaacttcagcaagaaatgtgatacaacttgggcactaaaagaagccacagaacaggaagcggtcatgaaagtgccatggatgaacactggaggtgggcagtgcctgtttatgaactaaataaataaatattaaacacctaaaatattag

SEQ ID NO: 56059 - DNA, 159 bp, Homo sapiens
  misc_feature 2, 9, 49, 60: n = A,T,C or G
gnataaggnggctccatagctttatttgtaagtaggctggataaatggngcttaaatggnaatgtactccacttcttcctattggaagattaacattatttaccaagaaggacttaagggagtaaggggcgcagattagcattgctcatgagtatgatt

SEQ ID NO: 56060 - DNA, 132 bp, Homo sapiens
  misc_feature 2, 5, 14, 29, 37, 50: n = A,T,C or G
gnagnacagtaccntcaaacgtgagtaanttcagacnaaacctcaaagangttaaagttaaaaaagtggtttggaccttgggaaccaggaactttataccctcttttactgtaacaagtacctcattaaagg

SEQ ID NO: 56061 - DNA, 480 bp, Homo sapiens
gctggatgttgatgtcctgcatctaacgcggtgtaacccccgagccgagcgagctccggaggaatttcagtatctgctacggtaacttcatcagcccgccaagatggcgatgcaagtggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtgggttttgtactataatgccaacagggcatttcagaagatggacacaaagaagaaggaggaacagttgaagcttctcaaggagaaatatggcatcaacacagatccaccaaaat

SEQ ID NO: 56062 - DNA, 452 bp, Homo sapiens
  misc_feature 21: n = A,T,C or G
tagcctgtgctcatcccaatncaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggccccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattg

SEQ ID NO: 56063 - DNA, 500 bp, Homo sapiens
  misc_feature 6, 7: n = A,T,C or G
tcggcnnttatggcctggaagtgatgtaatttaaaacctaagttgtgtttcaaaacaacaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgattatccttcaggggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgt

SEQ ID NO: 56064 - DNA, 316 bp, Homo sapiens
  misc_feature 4, 5, 100: n = A,T,C or G
atgnnttatggcgggggaacagctaaaagagcacacccgtctatgtagcaaaatagtgggaagatttataggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccc

SEQ ID NO: 56065 - DNA, 500 bp, Homo sapiens
  misc_feature 5, 7: n = A,T,C or G
aagananaggggacatttggcttccggtttgtgtgagagcttttctttccccatcagctcaacagtcagtccccagatctagagatggagagcttgggacaaggtcagaatgaaacatcaccagtcaatcctgctcaacaggtaactcttgcagcaatccttaaggaaaggggtgcagggtctcttcatggaataagcaaacaaagcccatgttgtgtgacgggtggcaacactttcagacttggatcctgcacattctgatgtgtaaattccacgatagggcaaaagcatgccactccacactaatgctgccctctcactaaattaaaccttggaaaaataagatgtggcttggctttaaaactcagtgaactatctttatggtacagtttggtttccatagctgtaaacacaaaagatctatggtttctgcctacccaggatagtcttgtctctagacaatgtatttgatgatgcaaatgttctggaactaatagggg

SEQ ID NO: 56066 - DNA, 391 bp, Homo sapiens
  misc_feature 343: n = A,T,C or G
gggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgaatgatggtcaaaacatcatcaaaaaggacattcagaacatgatcgtggaaggagtgtngggtgctcataaaagttgcccagcccagggggaaagggagcaaggagt

SEQ ID NO: 56067 - DNA, 485 bp, Homo sapiens
  misc_feature 28: n = A,T,C or G
tatggccggggaggcattgaggcagccngcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttgtaggtgattaaaataattttggaaggcgatcttttaaaaagagattaaaccgaaggtg

SEQ ID NO: 56068 - DNA, 472 bp, Homo sapiens
  misc_feature 437, 455: n = A,T,C or G
gagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcattttaatgactttccctgctgttacctaattacaaattggatggaactgnggtttttttctgctttgntttttcagtttgctgtt

SEQ ID NO: 56069 - DNA, 470 bp, Homo sapiens
gagaaagatttggttataagggttcctgctttcacagaattattccagggtttatgtgtcagggtggtgacttcacacgccataatggcactggtggcaagtccatctatggggagaaatttgaagatgagaactccatcctaaagcatacgggtcctggcatcttgtccatggcaaatgctggacccaatacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgt

SEQ ID NO: 56070 - DNA, 459 bp, Homo sapiens
  misc_feature 4: n = A,T,C or G
gacnctttatggcgcggggggagagggtcatacactccctagtgacttctactctatgctccagctttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatttctcatacttttaacatactctgcaatccaccaagatattggtagaaaccctggaaatttcaaatctatttcgtctgctaatgccatgtgaatgggaaacttagatacaggctggcctacaaggactccttatacttcaatttttgttcctcctttcaactctcataaaaaatattttctatac

SEQ ID NO: 56071 - DNA, 497 bp, Homo sapiens
  misc_feature 7: n = A,T,C or G
atggcgngggaaaaaatgttaagggcagacagacagaaaggttgggttacccacaaagggaagcccaccagactaacagcagatctctcggtagaaagatacaagccagaagagattgggggccaatactcaatattctcaaagaaaattttcaacccagaatttcatatctagccaaattatgcttcacaagcaaaggagaaataaaatcctttgcagacaagcaaatgctgagaggattttgtcaccaccacgcctggcttacaagagttcctgaaggaagcactaaacatggaaaggaacaactggtaccagcaactgcaaaaacataccaaattgtaaagatcattgatgctatgaagaaactgcatcaactaatgggcaaaataactagttagcatcataatggcacgatcaaattcacacatatcaatattaactttaaatgtaaatggacctaattgccccaactaaaagacacagactggcaaattgga

SEQ ID NO: 56072 - DNA, 213 bp, Homo sapiens
  misc_feature 14: n = A,T,C or G
aaattatgtaatgnaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 56073 - DNA, 471 bp, Homo sapiens
aaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaatagggcactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttag

SEQ ID NO: 56074 - DNA, 476 bp, Homo sapiens
  misc_feature 10, 19: n = A,T,C or G
attctaattngttgcaagnagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagat

SEQ ID NO: 56075 - DNA, 141 bp, Homo sapiens
gagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattc

SEQ ID NO: 56076 - DNA, 500 bp, Homo sapiens
  misc_feature 2, 7: n = A,T,C or G
tnggccnttattggccggggaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttttgttttattagacccaagacaagttctaaaaattgaatgcaatgagagattgtccagaaatgtaatatatactaaaatataccacttaagcattgattgccttttcttgtttgcttcaagaatataaaacttgtt

SEQ ID NO: 56077 - DNA, 373 bp, Homo sapiens
gtgaaaacctcatgttcaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgttttgtttgtttttcctgagggctagatgcattttttttctcacactcttaatgacttttaacatttatactgagcatccatagatatattcctagaagatggagaagaattattccttattgaccattaatgtcatgttcattttaatgt

SEQ ID NO: 56078 - DNA, 427 bp, Homo sapiens
tatggccggggtggcaaattcaaggtggcgtcccttccgtaaaaagtatgagctcagggcccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtaagttgagggtgacttttcctgctgcctggcctttataattttactcactcactctgatttatgttttgatcaaatttgaacttcattttggggggtatttttggtactgtgatggggtcatcaaattattaatctgaaaatagcaacccagaatg

SEQ ID NO: 56079 - DNA, 197 bp, Homo sapiens
  misc_feature 3, 27, 32, 41, 56: n = A,T,C or G
ctntggcccgggggtgttcagagctantaccnttgccgttntacctgagagagtantctgaattttagtagtaaattgttttgccaactgtatatttatgtaataagtgcaataaaatgcagtaaattttaaaattctcttaagataatgtgtgaacttaatttttgaaataaaaattgttattgtgttaaaattat

SEQ ID NO: 56080 - DNA, 496 bp, Homo sapiens
  misc_feature 7: n = A,T,C or G
tcggccntttatggcccgggaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaac

SEQ ID NO: 56081 - DNA, 383 bp, Homo sapiens
  misc_feature 27, 28: n = A,T,C or G
ggacgactgtggcagagaaggcccggnngggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatacttggtcgtcttgttataggagatcacaaatcaacatctcacttccgaaccggggaaagaagacaagaaaattaatgaaga

SEQ ID NO: 56082 - DNA, 173 bp, Homo sapiens
gggcaccgtggccctgctccaggaagaagcagaaggctcagaagaccccctacatcgtgctcagcggcagcggcaagagcatgaacgcgaacaccatcaccaagtgacagcgccctcccaccccggccctgcctcaaccttcatattaaataaagctccctccttattttttc

SEQ ID NO: 56083 - DNA, 472 bp, Homo sapiens
  misc_feature 15: n = A,T,C or G
aacattttaaagacncacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaacgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctct

SEQ ID NO: 56084 - DNA, 382 bp, Homo sapiens
  misc_feature 344: n = A,T,C or G
ggtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatnttggaagacacagatgatgatgatgatgatgatgatga

SEQ ID NO: 56085 - DNA, 468 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatggcggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttggaaggcgatcttttaaaaagagattaaaccg

SEQ ID NO: 56086 - DNA, 234 bp, Homo sapiens
  misc_feature 2, 6, 33: n = A,T,C or G
cnaaangctttgctcatttctatatgagtgggnttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggac

SEQ ID NO: 56087 - DNA, 481 bp, Homo sapiens
  misc_feature 10: n = A,T,C or G
cacacaaggnaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagtcctgaaataaaatacactaggatctctactggaggtggagaaacagaagaaactctgaagaaattgttacaagaagacacacccggaggaagttgcaagccaacaaaaaagttcaaggatctagaagacgattaagggaaaggtcgttctcagtgaaaatccaaaaaccagaaaaaaatgtttatacaaccctaagtcaataacctgaccttagaaaattgtgagagcca

SEQ ID NO: 56088 - DNA, 473 bp, Homo sapiens
  misc_feature 457: n = A,T,C or G
gggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagaaaagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtatttgngggggctcataaaaca

SEQ ID NO: 56089 - DNA, 336 bp, Homo sapiens
ggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattatttttttatactgtatgtgccaaagctttactactgtggaaagacaactgttttaataaaagatttacattcc

SEQ ID NO: 56090 - DNA, 476 bp, Homo sapiens
ctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaataatattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattgg

SEQ ID NO: 56091 - DNA, 247 bp, Homo sapiens
  misc_feature 2, 5: n = A,T,C or G
cngantcattatggtccgggaaggttgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattg

SEQ ID NO: 56092 - DNA, 498 bp, Homo sapiens
  misc_feature 1, 10, 34, 35, 47, 51, 54, 59, 62, 69, 72, 73, 77, 78, 89,315: n = A,T,C or G
ntggtcgggnaagtttttctttgctgaggggcanncatgaagggaanttgnggnggtanccncctgcgnggnngganntgaagaaaatntaacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggngtacaaaactttttatatcaaaaggctttgacatttctatatgagtgggtttactggtaaattatgttatttttttacaactaattttgtactctcagaatgcttgtcatatgcttcttgcaatgcatattttttaatctcaaacgtttcaataaaaccatttttcagatataaagagaatta

SEQ ID NO: 56093 - DNA, 474 bp, Homo sapiens
gaagtggatgcccttaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccat

SEQ ID NO: 56094 - DNA, 310 bp, Homo sapiens
gcttttccccggttgctgcttgcttgtcctggtccgcgccagagcccagcgcgcctcgtcgccatgcctcggaaaattgaggaaatcaaggacttcctgctcacagccccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcaggtgaaggaactgaaatgaaccagacacactgattggaactgtattttttt

SEQ ID NO: 56095 - DNA, 476 bp, Homo sapiens
  misc_feature 32: n = A,T,C or G
gataagcattttggtattcagcttttatattnactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaagcaattgcagtactttctagagtctaggttttgaaattctttttggtgaacatttactaaatcagctaaacatttcaactcatttaaacacaaacctaaattattattaccctagacagagagatgatatagcaacggga

SEQ ID NO: 56096 - DNA, 461 bp, Homo sapiens
  misc_feature 9, 46, 452: n = A,T,C or G
ggaagccgnctagtgcaggagcggttgtgaaaacagcagcaatgcnatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaaggtgtttgggatccggaccctcagtttctgntgtttcttt

SEQ ID NO: 56097 - DNA, 500 bp, Homo sapiens
  misc_feature 8, 25, 46, 483: n = A,T,C or G
gattttgnatccggggtaattcggnttttatggcgcggggggatgncgtggcgctttaggggaagaagttggtgtttcgctgggccctggtactgaagacgcggtccgggtcgcccctagctgtttcctactcacccaaagccccgacccgccttttctctctctcctctggcaggatgaggcgtgcaggcctgggtgaaggagtacctcctggcaactatgggaactatggctatgctaatagtgggtatagtgcctgtgaggaagaaaatgagaggctcactgaaagtctgagaagcaaagtaactgctataaaatctctttccattgaaataggccatgaagttaaaacccaggataaattattagctgaaatggattcacaatttgattccacaactggatttctaggtaaaactatgggcaaactgaagattttatccagagggagccaaacaaagctgctgtgctatatgatgctgntttctttatttgtcttt

SEQ ID NO: 56098 - DNA, 403 bp, Homo sapiens
  misc_feature 2, 3, 32: n = A,T,C or G
gnnttatggcgcgggaatcgaacacgcaaggntgtgagactacctattgtagatattgcaccctatgacattggtggtcctgatcaagaatttggtgtggacgttggccctgtttgctttttataaaccaaactctatctgaaatcccaacaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgg

SEQ ID NO: 56099 - DNA, 468 bp, Homo sapiens
  misc_feature 333, 441: n = A,T,C or G
caggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgnggttttattcacataagcacaatatgtgttttattttataacttcataacaaacttataatataaataatttaccctttagcagacatgcaaaagcttattcttgggngacttactttctttaagctaataatat

SEQ ID NO: 56100 - DNA, 472 bp, Homo sapiens
ggtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacaggaaaggaactggctaccgttcggactatttgtagtcatgtacagaacatgatcaagggtgttacactgggcttccgttacaagatgaggtctgtgtatgctcacttccccatcaacgttgttatccaggagaatgggtctctttgttgaaatccgaaatttcttgggtgaaaaatatatccgcagggttcggatgagacccaggtgttgcttgttcagtatctcaagcccagaaagatgaattaatccttgaaggaaatgacattgg

SEQ ID NO: 56101 - DNA, 330 bp, Homo sapiens
  misc_feature 2, 3: n = A,T,C or G
gnnttatggcgcgggcacttggcacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgct

SEQ ID NO: 56102 - DNA, 215 bp, Homo sapiens
  misc_feature 88, 113, 125, 171, 196, 205: n = A,T,C or G
atatcactgcaaaaatagcattgcatacatggatcaggccagtggaaatgtaaagaaggccctgaagctgatggggtcaaatgaaggngaattcaaggctgaaggaaatagcnaattcacctacncagttctggaggatggttgcaccgaaacacactggggaatggagcnaaacagtctttgaatatcgaacacnccaggctgngagactacct

SEQ ID NO: 56103 - DNA, 384 bp, Homo sapiens
  misc_feature 3, 4, 83: n = A,T,C or G
tgnnattatggtcgcgggggatcctaggttcttgcctgactgctttctccaactgttcacagcaaatgcttggattttatgcngtaggcattactacagtacatggctaatcttcccaaaaactagctcattaaagatggaatagaccagctctcttcagtgaagaggacaaatagtttatttaaagcatttgttccaataaaataaatagagggaaacttggatgctaaaattacatgaataggaatcttcctggcacttagtgtttctatgttattggaaaatgatgttccagaaagattacttttttcctcttatttttactgccattgtcgacctattgtgggacatttttatatattgaatctgggttcttttttgact

SEQ ID NO: 56104 - DNA, 378 bp, Homo sapiens
  misc_feature 7: n = A,T,C or G
attggcncggggctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcaggtgaaggaactgaaatgaaccagacacactgattggaactgtattatattaaaatactaaaaat

SEQ ID NO: 56105 - DNA, 469 bp, Homo sapiens
atttttgacaaaggcccaaaaacatacattgagggaaagaacagtctttttaataaatggtactggggaaattggatattcacatgcataaaaatgaaactagacccccacctttcaccatatgcaaagatcaagtcaaaacggattaaacatttaaatgtaagaattgaaactacaaaactactagaaaaaacactgggaaaatgcttaaggtcattggtttgagcaaatatatatatttttaaaataagacttccaaagcacaggcagcacaaacaaaaatagacaaatgggattatatcaagataaaaagctgctgcacagtacaagaaaacattaacagagtaaacagacaacctacagaaggggcaaaaatattcacaaaccatctactttagtatccattaataactagaatatatagaaaacttaaacaactcaatagcaaaaaaaaaaacccaaataatac

SEQ ID NO: 56106 - DNA, 290 bp, Homo sapiens
tatggccggggagaactttaaggttgtctttttaactgccggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgacatggttaatctggaacttacgttcttataccaataaaaggtacctcaatacatgttctttcaattgc

SEQ ID NO: 56107 - DNA, 255 bp, Homo sapiens
caacaaaaaaaatttaactcctatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatg

SEQ ID NO: 56108 - DNA, 488 bp, Homo sapiens
  misc_feature 29, 64, 78, 83: n = A,T,C or G
gcgcggggaattccggtagttgctctcangagcagcgtgcgggggtgctctttgtgaaattccnccatggcgtaccgnggccngggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgt

SEQ ID NO: 56109 - DNA, 467 bp, Homo sapiens
ggggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacacggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaagggaggtggtcttaaataaattaaac

SEQ ID NO: 56110 - DNA, 469 bp, Homo sapiens
gatgaggttgagggggtagtggaaagcatgtattgctagtaagccccaggtacagctatgtgagagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaat

SEQ ID NO: 56111 - DNA, 498 bp, Homo sapiens
  misc_feature 1, 19, 36, 37, 43: n = A,T,C or G
ntggcccgggggcattatnttggtggattcttgtcnntagtgnatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtgccaatggtgcctcctggaatcaagtatctttaccttaggaataaccagattgaccatattgatgaaaaggcctttgagaatgtaactgatctgcagtggctcattctagatcacaaccttctagaaaactccaagaatattgcaaaatacatgaagcttcatgcacttaaagaagtatttttagaataaagaaatttgcatacttacct

SEQ ID NO: 56112 - DNA, 379 bp, Homo sapiens
gctttctccgcctcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggaggcattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggcttggattcagtaataaatattgtaaggcctttcttttt

SEQ ID NO: 56113 - DNA, 408 bp, Homo sapiens
caagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagg

SEQ ID NO: 56114 - DNA, 169 bp, Homo sapiens
  misc_feature 2, 3: n = A,T,C or G
annattgcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccgggg

SEQ ID NO: 56115 - DNA, 149 bp, Homo sapiens
  misc_feature 5, 14, 17, 33, 40: n = A,T,C or G
ctgtnatacttgcnttnatgtttgagaagaagngaaaagnttgccttctgacctcatttccttcttgatcagtgaacactaacattttggggacaacttagtcaattggttttccttacaacaaaataaagtaaaatgtagcagtctgc

SEQ ID NO: 56116 - DNA, 417 bp, Homo sapiens
  misc_feature 2, 9, 413: n = A,T,C or G
anattagangtttgaaaacacagcacaagactctgtattgatacgggtactttgtgtcaatattctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatattggatatatatatgtatatacacatatatatatacacacacacacacatatatatatatatatatacacatatactaataactttnccct

SEQ ID NO: 56117 - DNA, 317 bp, Homo sapiens
  misc_feature 190, 191: n = A,T,C or G
gggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatnncagcttgttttggactttgttacactgttattttcagcatgaaaatgtgtgtttttttagggtttctgattcttcaaagaggcacagagccaaattggtagaggaaggatgcaaagtataaatttg

SEQ ID NO: 56118 - DNA, 472 bp, Homo sapiens
attatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaatt

SEQ ID NO: 56119 - DNA, 349 bp, Homo sapiens
  misc_feature 8: n = A,T,C or G
gatttttnatcggctcattcccttacaatctttttctcagggataaggttttctaagtcaatattttcccaaatgcatgcccttttgtcttccattaaatatggtagtctttgtttcttcaatggccatgtgagaacagaaggaaaatttcttctcagagaagacagagcaaagtaatattcttgccaaaagttatcacagtttaatagcaagaaggaatgtacacgtctctaaacaaaatgtgcaatgctttctgatgctgacaccatttatttagtcttattaaatagctggtaaaatgatccaagtttcagagaaacacaagctgtaagtggctgctgcacgtgac

SEQ ID NO: 56120 - DNA, 197 bp, Homo sapiens
  misc_feature 4, 22, 27, 32, 52: n = A,T,C or G
gtgnccgacaaaattccgttantttangttcnaaaatgttaggaaacagtanaatttgacaaagaaaaatgatactttctctttttttgctgttccaccaaatacaattcaaatgctttttgttttatttttttaccaattccaatttcaaaatgtctcaatggtgctataataaataaacttcaacactctttatg

SEQ ID NO: 56121 - DNA, 312 bp, Homo sapiens
  misc_feature 2, 17, 30, 235: n = A,T,C or G
tncggggtagttcggcntttatggcgcggnctagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacnttgtataagaaacctttgatcactaaaaataatgtaaaaattgggtttagtagcctaatacacataacgttcttctt

SEQ ID NO: 56122 - DNA, 476 bp, Homo sapiens
  misc_feature 11, 18, 25, 31, 63, 70, 89, 167, 445: n = A,T,C or G
atggtcgcggntagctanaatattncctgtncattatttccttgtaaaaaccagtcttttccntttaccnggaggcaggtacatctgcnagtagttacttccagcagataatcctgtctagttttagactgatagaaattttgtaatatctatagctatatactggngattggatgacaacacgaaatcacttgcccttgttggatttcagctctgtaagtatattgggtcttaaacatgttaaattttcctttttttgacacttaaagtaaactctgaagagggtggaagcctttttacacttgaaaaatctagaaaatgccctatgtattcaaatcacattgttgccagtgtttaacacataaacacagatctcttcaaatcacttgtgcatttggtgagcagcttgccagcacacaccagtagtaggaggaagttaaatggnggtgaaaaaataggtactgttttatcttttg

SEQ ID NO: 56123 - DNA, 500 bp, Homo sapiens
  misc_feature 8, 18: n = A,T,C or G
cagtaganaatgaaagantcctccagtgtcttggcaaaatgctctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctc

SEQ ID NO: 56124 - DNA, 450 bp, Homo sapiens
  misc_feature 13: n = A,T,C or G
atggcgcggggantaaaacctttaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggcaaaggaaatggttttattgcccatagtcatttaggctggaaaaaagttgaaaacttaacgaaatattgccaagagattgttatgtgtttggttccagcctaaaaatgattttgtaggtgttgaaatcatagctacttacatagctttttcatatttctttcttagttgttggcactcttaggtctta

SEQ ID NO: 56125 - DNA, 250 bp, Homo sapiens
  misc_feature 4, 29, 34, 69: n = A,T,C or G
aacnagtaaccttagcattacctctcatntaccnaggtactttctgctttttgaggggaaaaacattantaagatattcaagaaggaagtattaccaacaagatggtagagtaggagaccctggccctcaaccccacaaacaacaatctgatagacatccaggaatggaaatagctgtgggagggctttggagtccagataagaagctgcggcagcatagtagagcaaaaaagcaaagcaaaaccaaccc

SEQ ID NO: 56126 - DNA, 334 bp, Homo sapiens
gggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaaga

SEQ ID NO: 56127 - DNA, 499 bp, Homo sapiens
  misc_feature 14, 35, 36, 38, 59, 73, 74, 79, 80: n = A,T,C or G
cttatggtcgcggngaattcctgaagactgacagnntncgggccgagcatgtctcgctncgtaggagcttagnngtgcnnagcgcgtacctctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgctt

SEQ ID NO: 56128 - DNA, 263 bp, Homo sapiens
  misc_feature 6, 14: n = A,T,C or G
ccttcnggggtccnaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggccttgagagact

SEQ ID NO: 56129 - DNA, 412 bp, Homo sapiens
  misc_feature 3, 6, 33, 53, 76: n = A,T,C or G
tcngcnttatggcgcggggggagccgttctgtntcaaaggaatattataatcngacgggccgtatacctgattggngttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagcagtttg

SEQ ID NO: 56130 - DNA, 302 bp, Homo sapiens
tatggccggggcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacc

SEQ ID NO: 56131 - DNA, 130 bp, Homo sapiens
  misc_feature 36, 39, 59, 98, 129: n = A,T,C or G
atatgtgcctttcttaagatttaaatacaaactgtngtnactccttaagacttcaggcnttctgcgaaagctctaagaatatcttcattactatgctngggcaactggaagatggtgttaataaggtcng

SEQ ID NO: 56132 - DNA, 401 bp, Homo sapiens
  misc_feature 2, 7: n = A,T,C or G
cnaaganaggatccgagtaacgctctaagccctgtccacgagcctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgcgatactttc

SEQ ID NO: 56133 - DNA, 479 bp, Homo sapiens
gtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttct

SEQ ID NO: 56134 - DNA, 125 bp, Homo sapiens
ggctattaaaagaatgcaagcattttgaactgggaggagataagaagagaaagggccaagtgatccagttctaagtgtcatcttttattatgaagacaataaaatcttgagtttatgttcacttc

SEQ ID NO: 56135 - DNA, 405 bp, Homo sapiens
gagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttct

SEQ ID NO: 56136 - DNA, 336 bp, Homo sapiens
  misc_feature 18, 319, 322: n = A,T,C or G
tatggccgggggaaaganagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatcctggttggatgaaaaacccagntanccattaaaatgacc

SEQ ID NO: 56137 - DNA, 471 bp, Homo sapiens
atttggagctgagaaaaatgttgtgagaagggtacatgacatttacactgttaggacaaatgctcagattctggaatcaatgtagtcttaaacagaagtgttactttgtggttatttttcctctgtagtgaaatatggttttgagtttgatttttcatatccaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggta

SEQ ID NO: 56138 - DNA, 297 bp, Homo sapiens
  misc_feature 20: n = A,T,C or G
cttcacgatatacaaaaatnaactcaagatggattaaagacttaaatataaaacctaaaagtattaaattcctagaagaaaacccaggaaatgccattctggacataagtgctggaaaagacttaatgatgaacaccccaaagcaattgcaacaaaaacaaaaattgacaagtgggacctaattaaactaaataacttctgcacagcaaaagaagctatttgcagactacagaatgggagaaaatgtttacaaactgcatctgacaaagatctaatccagaatctataaagaactca

SEQ ID NO: 56139 - DNA, 166 bp, Homo sapiens
  misc_feature 14: n = A,T,C or G
attggaggcaaganttgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtcc

SEQ ID NO: 56140 - DNA, 397 bp, Homo sapiens
  misc_feature 23: n = A,T,C or G
aaagcatatgcagccaaccaagnagcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattct

SEQ ID NO: 56141 - DNA, 482 bp, Homo sapiens
actgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacatttacccacatacatttttacattgtaccttaggactcagtcatctccacttaaattgatgacacaagcagctaataaccatttctgggtttctgcctaaccccctaattgtctgttaaagccaattctctgggtgtcccagtgaggtgggggcttt

SEQ ID NO: 56142 - DNA, 447 bp, Homo sapiens
  misc_feature 9: n = A,T,C or G
ggacagaanatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatg

SEQ ID NO: 56143 - DNA, 471 bp, Homo sapiens
actgaaaaaaacccagattaatagcattttttaccaatctttgatataatctatacttgtatgtatgtggatatttattcaaatgataaatacagcatgtttctcacagtcaatttgaaggagtatgttgtgatagaagtacagtgtgccttgtgtggaacaaggtttatgcaaagatgctgcattaattgcctttatagcatttatgtattatgagaattttatgctttattcagttggaagttatttttgtatatattatgttgatagaatttctttcttcaagaatctcttgtttaagagagcctcacctaaaatatctatcaaatttaaatctgtagtgtttttctttttctatattgacaattttgtgtaaacaattttcactttcctgaaagttccctctttttagtacaactgcttccctagattgtctccacaatgcagttcaagactgaaaattttctgcta

SEQ ID NO: 56144 - DNA, 470 bp, Homo sapiens
ggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgccatcaggaagttatgacaaggcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagtt

SEQ ID NO: 56145 - DNA, 102 bp, Homo sapiens
  misc_feature 82, 88, 89: n = A,T,C or G
ctcaaatgcgggcgcatgcctaaccttgctgtgaagctaggagtgcgactgggccgaggcgtcaacttggacctttctcttnccaagnncattataaggtcg

SEQ ID NO: 56146 - DNA, 314 bp, Homo sapiens
  misc_feature 7, 19, 27, 40, 44, 47, 49, 74: n = A,T,C or G
tattgcntactgctgctanacaagtancctgagtactganctgnagngngaaaccatgaagagcctgatccttnttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgcaatggtttatg

SEQ ID NO: 56147 - DNA, 300 bp, Homo sapiens
  misc_feature 6, 47: n = A,T,C or G
tcgttncttatggtccgggtaatggagaacatagtatgtagcagagntagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttacttggctttggagagcctctcagtccaggtgaaataaggtttat

SEQ ID NO: 56148 - DNA, 461 bp, Homo sapiens
  misc_feature 2: n = A,T,C or G
anagaaatttttaagtggttacctccacggaatgggattaggggatcagaggtgagggaactcatggtttggctatttctcgttctttctgcactgtttcaaatttttacaagtgtatgttattgtacttttaaaaagattagtttggcaacaagtctagcctgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatcccttgcttttaagtattattatagacttttggagactcacgaaacaagcaatccctaaattctcgcccaggaaagtatcttggattaaatggtttttgagaaccttgagagtgtatattctatgaaatggaagaaac

SEQ ID NO: 56149 - DNA, 469 bp, Homo sapiens
  misc_feature 9, 25, 32, 57: n = A,T,C or G
atggcgggntgaaatcccaacaaanaaaaatntaactcctatgtgttcctcttgttntaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgcattctatgagtcccagaagatgaaaaaaatttatac

SEQ ID NO: 56150 - DNA, 415 bp, Homo sapiens
  misc_feature 3, 6: n = A,T,C or G
canccngggaattcggccttatggccgagatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccaacggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcaga

SEQ ID NO: 56151 - DNA, 280 bp, Homo sapiens
  misc_feature 4, 5, 6, 11, 18, 19, 26, 272: n = A,T,C or G
tggnnngatgngggcgcnntgatgantgtgtgtgcatttatgagtgtgtgtgtttctgtacatagtagaaccaagagacctcttgggttccatttcagtaagacatgcttaggggagttgcccattttaaatcacctggatatcttctaagcaagacacttaactgaattgactccaagtgaccagacctgttaacgtttcccctgtctctgatgggaaagctgttgtctgtgtctctactttagccaacctaagtacctaccatgggtggnatatcaca

SEQ ID NO: 56152 - DNA, 328 bp, Homo sapiens
aataattttctacttctcttaaaattttttttatcttgtcccctctccctctgttggagttttagtaggttgcattacatttatggattaattttggggagaattgaaatacattcggtgttgatattgtgtatttttccataaacacgtggtttttattaacatgtatttaaaaaaaatttagcatataattaggtgaactaggagacttttaaaaataaatattctagcctccttgtaacatactgaattatacaggtatttggctctctcttttcaattgataattgactgagaaagaaagctaagtcttcctgctttttcattt

SEQ ID NO: 56153 - DNA, 434 bp, Homo sapiens
aatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttat

SEQ ID NO: 56154 - DNA, 464 bp, Homo sapiens
  misc_feature 422: n = A,T,C or G
attttaaaaaattggctcatgtaataatggaggctagcaagtccaaaatttgaagggcggactggcaagctggatactcagggaagagctaatgtttcagttcaacaccaaaggccatcagactggagactaaagaaagagccgatgttgcagctcaagtccaatgtatgtctgttgcagaatttcctcctactcagaagaggttagagttttgttctactctcttttaactcatagcatgagcccactcacattatagagggcaatcttctttacttaaagcccatcaatttaaatggtaacttcatccaaaaacactcacaaagaaacatccaaaataatgttttaccacacatcctggcactgtggcccagccaggttgacacatagaattaaccatcacaatctcttagaagaaaatntagaagtaaattttttatgaccttgtatttggcaatgaatta

SEQ ID NO: 56155 - DNA, 482 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctttttttctggaggctggcacctgattttgtatccccctgtagcagcattactgaaatacataggcttatatacaatgcttctt

SEQ ID NO: 56156 - DNA, 480 bp, Homo sapiens
agaagactgagattcaccgaaggtaaagaacaagaagagaagtccggtgaagatggtgagaaagacacaaaggatgaccagacagagcaggaacctaatatgcttcttgaacctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatccca

SEQ ID NO: 56157 - DNA, 464 bp, Homo sapiens
ggagcatttaagaagcatcctctgccaagaccaaaggaaagaagaaaaagggccaaaagccaaaatgaaactgatggtacttgttttcaccattgggctaactttgctgctaggagttcaagccatgcctgcaaatcgcctctcctgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattag

SEQ ID NO: 56158 - DNA, 467 bp, Homo sapiens
gatgacactgtcttatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtagttctcccagcagagatgtgggtccttccctgggtctgaagaagtcaagctcattggagagtctgcagaccgcagttgccgaggtgactttgaatggggatattcctttccatcgtccacggccgcggataatcagaggcaggggatgcaatgagagcttcaga

SEQ ID NO: 56159 - DNA, 342 bp, Homo sapiens
  misc_feature 324, 333: n = A,T,C or G
cagcaaagtatacctgcttcttctatatgatacaatattttttttaaataaaagactaaagacagggagctagatgaaatggcttagtggtgctgttaagtatttgtacctaacagtcttgtgtgacagatgaaaataggatgtaacataatgaaacacacctgtctaggggcggcaatcaacagtcttacacagagagggtattccctgcaagtttctggcttgcctgtgatgggtgatgaggcttttagagaggtgttatacagggcgatttttggtgccttacttttatcttaatttttgccaatgtgaaaattaaggatnaatcagagntacagcagg

SEQ ID NO: 56160 - DNA, 417 bp, Homo sapiens
gaggcattgaggcagccagcgcaggggcttctgctgagggggcaggcggagcttgaggaaaccgcagataagtttttttctctttgaaagatagagattagtacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaatcaataccaatagaagggcaatgcttttagattaaaatgaaaggtgacttaaacagcttaaagtttagtttaaaagttg

SEQ ID NO: 56161 - DNA, 108 bp, Homo sapiens
  misc_feature 1, 3, 27, 34, 54, 65, 77: n = A,T,C or G
ngnccgcacgctagctcagagtgcgtnataacgngatatgatagatgaataagnctccttaatcnccatccttcttncatctgcaactgatactatgcggacctttag

SEQ ID NO: 56162 - DNA, 461 bp, Homo sapiens
gtttgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctgctcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctct

SEQ ID NO: 56163 - DNA, 473 bp, Homo sapiens
  misc_feature 459, 469: n = A,T,C or G
gaactcggtggtggcccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtgggaanaagtgggggnggga

SEQ ID NO: 56164 - DNA, 406 bp, Homo sapiens
gggcgggatctgtgtctctcgctggcgctggcacaggaacttgggatccgtctcctctttcgcctcctgcaccttgggagccctgggctactctctcacagcccctgttgccctgcgatctgtaggtccttggggacgcatagttaaggtgccaggacatcctggaagctgggaaatgatttcttccagaccatggctggagaaggaaagaaggtgtgttttgcctgactcagtgactatagagagaaccaagttctgcaggcctgtcacctaagtctcagctgggtgccacaaactctgaactggattccaaggctttcatgaatgcacttacgtttgctgtggcagctgcattatgtcgtggggggatgtggatgcagaacctcacattctgtcgtcttgctta

SEQ ID NO: 56165 - DNA, 125 bp, Homo sapiens
cgcataagcctgcgtcagattaaaacactgaactgacaattaacagcccaatatctacaatcaaccaacgagtcattattaccctcactgtcaacccaacacaggcatgctcataaggaaaggtt

SEQ ID NO: 56166 - DNA, 474 bp, Homo sapiens
  misc_feature 452: n = A,T,C or G
gatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagnaagaagccccacgggagccagg

SEQ ID NO: 56167 - DNA, 124 bp, Homo sapiens
  misc_feature 118: n = A,T,C or G
ctctccgtattgcatgtagatagcatttatttctgcgcccttagacccatttagaaaataactaccaagtactaaatgccgaggctatacgaaatgcattttttcgtgaacagtttgngataca

SEQ ID NO: 56168 - DNA, 465 bp, Homo sapiens
  misc_feature 9: n = A,T,C or G
ggagcaganaagaggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgcggtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgat

SEQ ID NO: 56169 - DNA, 465 bp, Homo sapiens
  misc_feature 410: n = A,T,C or G
attttaaggcagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatcttttnaaaggttaatgtctagccaagagtttagtaaacgaagaattaaactgcactgttg

SEQ ID NO: 56170 - DNA, 477 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgatta

SEQ ID NO: 56171 - DNA, 461 bp, Homo sapiens
  misc_feature 3: n = A,T,C or G
gantccggggaaattcggccttatggccgaggaatagagagagtaaacttgggtttgggaattcaaatgggcttttactttaattgtattgtttgacgtttttatccagcaggaatacatttgtgtgtttcctgtgtaatttaaaaactctaaaaataaatgcatccccaagtgatgtgcagaaggctggcactggttgaccccagacctgcccttcctgcaggtgatgagcttccgaatcagcctgagtagacatgggccgaagccctcccaccccaagtcagacagtttcagtttggcgggatccaaatccctcctgccctttaaggatctcaagcacacaggtccgtcatagttcagaacagtcacatagtgaagctgggcttcaagataaactgttgactgaaaaagcaaggtggggaaacatacaaggcacaagacattgtgaatagaattccaca

SEQ ID NO: 56172 - DNA, 426 bp, Homo sapiens
  misc_feature 4, 10, 70: n = A,T,C or G
taantcggcnttatggccgaggtgtatatatatatatatgtacagttatctaagttaatttaaagttgtntgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcagactgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgaga

SEQ ID NO: 56173 - DNA, 331 bp, Homo sapiens
  misc_feature 15, 28: n = A,T,C or G
ggtggagctgccagnagtaaagcaaagnagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttat

SEQ ID NO: 56174 - DNA, 472 bp, Homo sapiens
ggctttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtgggaagtc

SEQ ID NO: 56175 - DNA, 465 bp, Homo sapiens
agtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatactaaactttactgatgtatatccaaagcttctccttttcagacagattaatccagaagcagtcataaacagaagaat

SEQ ID NO: 56176 - DNA, 476 bp, Homo sapiens
  misc_feature 431: n = A,T,C or G
gtattatatgcatatataattttttaaagagtttttaaaagctgtgctttgcaggggtgactgaaatgcttgtctcagacaactgagacctgtgcaaggggattgatccatcagcatgtgcccatgtctgcttgatggcgcttatgtgtgtacagctagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtattgtgttgctttaattgcaaagaaaaaaaatgaatttaattttatactcgagacatttctttaaatactcctgaagtttgttctttagtattaanagttctacaaagggaattaactggggagaatagctgtaaaatact

SEQ ID NO: 56177 - DNA, 195 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagaga

SEQ ID NO: 56178 - DNA, 385 bp, Homo sapiens
  misc_feature 260, 336, 350, 366, 370, 384: n = A,T,C or G
gtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgttttaataaacatacaacacaagctggccttgngttgctggttcctattcagtatttcctggggattgtttgctttttaagtaaaacacttctgacccatagctcagtntgtctgaattccanaggtcacatcagcatntttntgctttgaaaactnt

SEQ ID NO: 56179 - DNA, 472 bp, Homo sapiens
  misc_feature 40: n = A,T,C or G
gctaaacctagccccaaacccactccaccttactaccagnacaaccttaaccaaaccatttacccaaataaagtataggcgatagaaattgaaacctggcgcaatagatatagtaccgcaagggaaagatgaaaaattataaccaagcataatatagtaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgt

SEQ ID NO: 56180 - DNA, 280 bp, Homo sapiens
gaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagagg

SEQ ID NO: 56181 - DNA, 335 bp, Homo sapiens
actcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaagg

SEQ ID NO: 56182 - DNA, 438 bp, Homo sapiens
ggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 56183 - DNA, 398 bp, Homo sapiens
aatttcaagagtgtgaccaccctgctctagtctcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatgggtgtttacaagtggatagataaggcggagatggtgaga

SEQ ID NO: 56184 - DNA, 349 bp, Homo sapiens
  misc_feature 12: n = A,T,C or G
gtctccaacaantaatgggaaatggaagggaacacaaaactgtggtcctgacaatactaattctacccgttttcaaataagaataattaaacttataaagtgatatactgattatttttgtgttactctccctttttttgtttaaagtcaaattccagaagtaaaaatctttatcatactgttttcctcttactaaaactggaagggtaaaatagaaagttcagcaacatcagaaaatgttgtatttaaaataatatggagaataggggttttaagtacataaaccatattggcttccttgtaggtttacttttagtatataacatgaatatgtagtgcttctttttac

SEQ ID NO: 56185 - DNA, 354 bp, Homo sapiens
  misc_feature 340: n = A,T,C or G
ggaacgaaaataagttggtcacattaacactggaagccatctttaagtgagtgctgtcatattgtgtcacagtaatttttagccaaatatggcatttgtaaatttaaactttctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcntaggatgcattaag

SEQ ID NO: 56186 - DNA, 456 bp, Homo sapiens
  misc_feature 6, 31: n = A,T,C or G
gaggcnttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 56187 - DNA, 362 bp, Homo sapiens
tgcacagcctgtattgtgtatgctagcagcctattactaaatctttctgggccccaagggtctcttttgcaagaaggacatagcaacttctcccttccagagttctccatcagaaagaggattgagagggtatgttatagaaactgttcaactctagtgcaaggttttaggagtcttcgtttccttccagttatttgagaaatgtggcttcttcaagcaactggaatactgaaagcctttttgatgggaatcactcctccctaaccacttccacccacaccttctttggtaaaacatttttgagaaaaattggttttgatctgaattctgaggaccaaaacagcctccaaaaatcaagcaca

SEQ ID NO: 56188 - DNA, 402 bp, Homo sapiens
  misc_feature 9: n = A,T,C or G
gagcacagnaagagcctcagtagagtcaagtcctgctgcagctgccccaccccaagtttctatcatttcctctttaaacaaaaaatatgttatcctacacattagtgtcaatccaatggttgcctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatg

SEQ ID NO: 56189 - DNA, 483 bp, Homo sapiens
ggcactgaagaagtaactgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatct

SEQ ID NO: 56190 - DNA, 340 bp, Homo sapiens
aaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctaccaccgtgtataaatcctggtgtctgctccttatcctggacatgaatgtattgtacactgacgcgtccccactcctgtacagctgctttgtttctttgcaatgcattgtatggctttataaatgataaagttaaaga

SEQ ID NO: 56191 - DNA, 357 bp, Homo sapiens
  misc_feature 6, 32: n = A,T,C or G
ctaaanacaaatgcaaataaatatcaaagtanaccacattcctggatgtgaagactcaacactgtaaaaatgtaatttcagtcaaaatctcgggaggaagctttggataatttaacaaattgattttcatatttgtgtatagtagtgaagatggccatatagctaatacagttttgaagaagatcaaattgagtggacttatccttttgcatactaacattataaatctatagtaattatcatgatgctatattggaacaatacaatggaaaagaataaagagtatagtaacagatctattcacacataggtacttagtataggattgagataaaatcataaatcaatgtgtaagtg

SEQ ID NO: 56192 - DNA, 458 bp, Homo sapiens
  misc_feature 6, 31: n = A,T,C or G
gaggcnttgaggcagccggcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagaga

SEQ ID NO: 56193 - DNA, 387 bp, Homo sapiens
  misc_feature 5: n = A,T,C or G
gtccntttttcttttttccggcgttcaagtatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacagga

SEQ ID NO: 56194 - DNA, 372 bp, Homo sapiens
  misc_feature 7, 18: n = A,T,C or G
tctcagngaaccctcgtnttttatggcccgggaacttgcgtcttttttagtttacttagaaagtactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatct

SEQ ID NO: 56195 - DNA, 124 bp, Homo sapiens
ccagctcttcaccccccaatctcttggtggggaggggtgtacctaaatatttatcatatccttgcccttgagtgcttgttagagagaaagagaactactaaggaaaataatattatttaaactc

SEQ ID NO: 56196 - DNA, 346 bp, Homo sapiens
  misc_feature 15: n = A,T,C or G
tatggccgagcaagnctttattaacaaagaacattctcttttatctataaagaaattcttaaagatgcattgacagtgttgaattaccaacagcctgtgaagatcagtttgaccggtgtggacacgtgctggttaagcactcaggcctacgtgggccgagcgggatcttgatcatggggctggtgtatggatccaccgtcggattccgtctgcagaggaggacgtagggggccgtcacacccaccaggcctccctgctgtgctttaacacaggcagaagaggttcatggcaatataatagtcaatgaactttcagtttaaattgtgtacatttttaaattgtaaga

SEQ ID NO: 56197 - DNA, 426 bp, Homo sapiens
gatgacaaattgcatcttgcttcttctcatgcggagactgtatataataatctctatcatttacaaagaaccttctgtgtgccagatactacagtagtcatagtagattcattatctctaagctttacctaaacatttaaaaagtacaattcagaaagattaagtaacttacataagattcttaatctcataaatgacagagcaaattttatatccatttcttcatttattccttggttaaactttcactaaatgcctactgtcttccaagtattattccaaagacactgaagatgcagaaatgaaaaagacgaggtttcagatctcatgattctacattctagtggaggatagagtcagtaaacaaagaagtgaatataaacatgaagaagtggtgaaggatataaaaaataaaatgtgataggg

SEQ ID NO: 56198 - DNA, 430 bp, Homo sapiens
  misc_feature 7, 8, 12, 36: n = A,T,C or G
gaaatgnnaagnaaaccaagcatccgagtgctttcnctctttttaattgctccaaaaggtatctgactatgtaaggcaaaaatagtaactgtattttgtttctgtagcacatgtaaaaataaaatatatgacaacaaaagatgggagggaggaattgactctacacatgatgtaaatattatttgaagatgaactcaaggtaactaaaggtgtatattataaaccctagtgcaactacggaagaaaattttaaagaagtataaataagtcagtagaagagataaaatagaaatataaaaaatgctctactaagtagcccaagaaatgggagaaaagaagacaaaaagcaagataatggtagcttttaatccagtcatataagtaatcacattgaatgtggtgagaaagcgtcagttaaaagattgtcaga

SEQ ID NO: 56199 - DNA, 179 bp, Homo sapiens
gaaaggaacattagggtcatcctggagagtttactgggccccgtctcagaggttctgatgctgtaaatcaggcgggacccctgaattttcatttctaagaagctcacaggtgctactaatgttgaagagaacctatgatctagttcaacttctgggatttcttgctttctttcttttgt

SEQ ID NO: 56200 - DNA, 437 bp, Homo sapiens
  misc_feature 32: n = A,T,C or G
ggttggccggcggattcgaacgttcggactgnggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacat

SEQ ID NO: 56201 - DNA, 150 bp, Homo sapiens
  misc_feature 6: n = A,T,C or G
ggtagnacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttaac

SEQ ID NO: 56202 - DNA, 426 bp, Homo sapiens
  misc_feature 7: n = A,T,C or G
gaggcanctgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatt

SEQ ID NO: 56203 - DNA, 353 bp, Homo sapiens
  misc_feature 32, 33: n = A,T,C or G
gaatgaagctggagcccagcgtcagaagcttnnttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgttgcagtcacatcacaatattcagtggtgaaatcttgtttgttactgtcattcccattccttttcgtttagaatcagaataaagttgtatttcaaatatct

SEQ ID NO: 56204 - DNA, 409 bp, Homo sapiens
  misc_feature 2, 5, 28, 39, 43, 60, 70, 150, 186, 195, 222, 239, 297, 364,381, 390: n = A,T,C or G
anacngcataaaatactcgcagggtttnttattccgatntctngcacaattatttagctnttggtaagtncaacatgtaaattttaaagacataaatatagagagacttatgtgtttgaatataaatgatatatatgggattagcatgtncctgtatattattaaacatgcaatgaactgactggnaagggacgnctaattgtatggctagcaatgtaattnattcagactgtattttngtacagagcagtgcactctaacctatgcctctgtgtcctctttaatgcctaaagctgnccctagaaatttcatctgtcttaaaagtaaaatatacttcatgctgtttatgctattaggtttctgnactgctattctatattnattattttnaaatatatgacatgtttac

SEQ ID NO: 56205 - DNA, 168 bp, Homo sapiens
ggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgctttttttt

SEQ ID NO: 56206 - DNA, 473 bp, Homo sapiens
  misc_feature 14: n = A,T,C or G
cagtgtctattttntgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaagtggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaattt

SEQ ID NO: 56207 - DNA, 456 bp, Homo sapiens
gaggccttgaggcagccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatggcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 56208 - DNA, 359 bp, Homo sapiens
  misc_feature 5, 7: n = A,T,C or G
gaacngnaagaaatatgaaattccagcaattagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataac

SEQ ID NO: 56209 - DNA, 468 bp, Homo sapiens
  misc_feature 6, 31: n = A,T,C or G
gatgtntgagtgaacatatgccactgcctgncctttttttcttcgagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtg

SEQ ID NO: 56210 - DNA, 469 bp, Homo sapiens
  misc_feature 13, 32: n = A,T,C or G
taaaaagtagagnacttgaaactgcatttatnaattcaaaaaaagtttagcaactatctaattaaaacagtgtttgactctgttgcattctgaacagaggccactcatcaggagctttaatagctgactctgttgaagatatagtactagtggggaatcaacatattttataaaggaagcacagaggtgtctcaacttgagccaaagggtggtgaaagtgaaaagttaaacccaaaccttggacggcaaacagagcactgcctgagcctcgtatctttcaagaggtgtgtccctttctggagcaagagccagcttggcttctaaaaattgattcttggagacttctggaaggaatgaccccagagtcctttccattattagaatgaagcacagaacacagagagctcttgaccatgaggaaaacctggacaagaaatcactttttttcccatatatgttttctacccat

SEQ ID NO: 56211 - DNA, 342 bp, Homo sapiens
  misc_feature 22, 34, 44: n = A,T,C or G
tatggccggaaaaattcgaatnaccctaacaagnccgcaacgtnaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatga

SEQ ID NO: 56212 - DNA, 226 bp, Homo sapiens
  misc_feature 32, 34: n = A,T,C or G
atctgcgagaacatcattttttcttctaatgntnaatctaaagttctaactagcttttcttgaccctactctgaaagtcatagttccactttggaggtggctctgtatagctcatgaccagcttatagcagttctacgaaggtgatccgatcttcagcctgttcactcagcaggagctccttgttgacttgtcatatcactaaataaacacgattttattgctgcg

SEQ ID NO: 56213 - DNA, 500 bp, Homo sapiens
tatggccgagaaaagtcacacactttggtgatggatcaagtatcaatattttcttatgtgaaagatagcttattattactattgtgacatacaactaatagtaacagttaacatcaacacttcatatataccaggcagcatgataagcactttattattttactgaatcctcacaacagaccactgaggtagggactattgccatcatcattttataaaaggaaattgaggtttagtcctcaagaagtcttggctattaaggggcacttatccatacaacctctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggctaggcgcagtgactcacgcctgtaatcccagcaccttgggaggctgaggcgggcagatcacgaggtcaggag

SEQ ID NO: 56214 - DNA, 467 bp, Homo sapiens
  misc_feature 32: n = A,T,C or G
ggttccgtgaatagcagtggcaaaatattatnttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggactattactac

SEQ ID NO: 56215 - DNA, 353 bp, Homo sapiens
agctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataagg

SEQ ID NO: 56216 - DNA, 221 bp, Homo sapiens
  misc_feature 8, 32, 35: n = A,T,C or G
acgatccnaaagggacaagcatcaagcacgcnttnatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcacc

SEQ ID NO: 56217 - DNA, 388 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagg

SEQ ID NO: 56218 - DNA, 105 bp, Homo sapiens
  misc_feature 15, 27, 105: n = A,T,C or G
ctcctgtattgagtngtatcgtgtggngtattttttaaaaaatttgatttagcattcatattttccatcttattcccaattaaaagtatgcagattatttgcccn

SEQ ID NO: 56219 - DNA, 374 bp, Homo sapiens
  misc_feature 7, 33: n = A,T,C or G
gaatccnagtatatgtggctaaaattggccttntcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcat

SEQ ID NO: 56220 - DNA, 210 bp, Homo sapiens
  misc_feature 8: n = A,T,C or G
aattcctnaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacc

SEQ ID NO: 56221 - DNA, 420 bp, Homo sapiens
  misc_feature 8: n = A,T,C or G
aaaggtcncaaggatttttctgctgtgttttgttctaggagttttatggatttttagcttttgcctttagacctatgatactttcaaattaactcttgtatttgtcatggagtatagattaaaactgattttcttttattgtagataccagtttcagcatcatttttttaaaagactatccccttcatcactgtgctttgtccctttgtctaaagtcggttgttcatatatgtgggtctgttccgtagactttattcagttctattgatcttttttgatatgatgccagtaccatactctgttagtaacgatagtgttttaataatacatcttgaaattaggaagtatagagttattttgcctatagtagatcctttattttgcattttagaatcagcttaagagtttctgcaaaaatac

SEQ ID NO: 56222 - DNA, 313 bp, Homo sapiens
  misc_feature 32, 59: n = A,T,C or G
aatgtccttattttgaaaaaataaatttaaanttacattcaaaattactattgtatacnagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgg

SEQ ID NO: 56223 - DNA, 448 bp, Homo sapiens
  misc_feature 28: n = A,T,C or G
gagtgctgttcatgacctctgtttcttntttttctctacagaccaatgagtggaacaagaatgatgaccggctactgcaggccgtggagaatggagatgcggagaaggtggcctcactgctcggcaagaagggggccagtgccaccaaacacgacagtgagggcaagaccgcgtaagctgaaacactggtttgcagatatgctggttctgggtttttggggtgttctctggaatccttagtatccataggggaatttcacacgtgctccctctccactcccatgttgaaatatgtaagaagatattttaatctagtgcctttctctccaaattccaagtcacatatggagctctaccttgaatgggtatacatgttcccaagtataagcaaaggttttacctcctaagattgcaaccaattgtagatgagacatgaattctctcttcg

SEQ ID NO: 56224 - DNA, 164 bp, Homo sapiens
  misc_feature 13: n = A,T,C or G
aggaataaaaagnggtcctattagaattctatgattcttaaccatttaaacaataatccatctaggaaaagagatgtccattagagctatgacaacatatggaagattaacatataacacactataccaaagatacatacacacacacacacacacacacacac

SEQ ID NO: 56225 - DNA, 309 bp, Homo sapiens
  misc_feature 5, 16, 39, 66, 74, 136, 174, 290, 296, 298: n = A,T,C or G
cccanggaacccagcntgttctttcccccatctgaccgnggggcttttggccattggcttgttctncaccgccnggttcttcgtttacgaggtcacctctaccaagtacactcgtgatatctataaagagctcctnatctccttagtggcctcactcttcatgggctttggagncctcttcctgctgctctgggttggcatctacgtgtgagcacccaagggtaacaaccagatggcttcactgaaacctgcttttgtaaattacttttttttactgtggctgaaagtgncccacntnctgctcataat

SEQ ID NO: 56226 - DNA, 255 bp, Homo sapiens
  misc_feature 24: n = A,T,C or G
ctgagggggcaggcggagcttgangaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagc

SEQ ID NO: 56227 - DNA, 499 bp, Homo sapiens
  misc_feature 2, 27, 460: n = A,T,C or G
tntttatggcgcgggatatgccccagnatacatactagtatttccatttttacaccctaaaaaaactaagccctgaattctcacagaaagatgtagaggttcccagttctatctgcttttaagcaaatgcccttactactctactgtctacttctgtgtactacatcatccaattctgaaagacataggcttccccatcccctgctaagactggttcaagtggcagctactgatggattgcagtgagaaggcatgcaaacacgtaccttcctggaagttgtctccaaaggctattgctctaagactcaagtatataaacactagaatgaatatcaactctatctagcaataaatgttatttttatattacagttgacccttgaacaacacagctgtgaacttcatgggccctctgacatgcagattttttttctcaactaagagcagattcagtattggngggactcagaacctgcatatacagagggctgactttcat

SEQ ID NO: 56228 - DNA, 343 bp, Homo sapiens
  misc_feature 2, 27: n = A,T,C or G
tnaaggactccttggaggaatccatcntttctgagtattgaaggttttaatatacattgaaagctctttaacaaaccaatgctctcttagttctaggataaaacagagttgcacacaagaaattaagggactgttcctcattatgacttagaaaaggcagcacctctctagtagactaagagcatgtctggacatccactggtagtgtaagaaaacggcattttttaaagaaggcaacaccattgcacttggcaaaactgaagtttttcttaattaaaaattttccattacacatttggggtgagagggtatctcagtaagagtacatttttttctggtttct

SEQ ID NO: 56229 - DNA, 121 bp, Homo sapiens
  misc_feature 21, 23, 30, 79, 92, 104: n = A,T,C or G
tgctgagggggcaggcggagncngaggaanccgcggaataagtttttttctttttgaaagatagagattattccacctncttaaaaaatttngccaataggttnctaagatatggcttacg

SEQ ID NO: 56230 - DNA, 500 bp, Homo sapiens
gttatttactttcctccgcttcagcaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacccgctggcagtcccaaatgaaattatgcaacctttgatatcatattccttgatttaaattggcttttgtgattgagtgaaactttataaagcatatggtcagttatttaattaaaaaggcaaaacctgaaccaccttctgcacttaaagaagtctaacag

SEQ ID NO: 56231 - DNA, 499 bp, Homo sapiens
  misc_feature 23, 361, 425: n = A,T,C or G
tctctgggtagcagggtggtgtnatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggngagaagttaaatggcacagatcctgaagatgtcatcagaaatgcctttgcttgctttgatgaanaagcaacctggcaccatacaggaagattacttgagagagctgctgacaaccatgggggatcggtttacagatga

SEQ ID NO: 56232 - DNA, 218 bp, Homo sapiens
cttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 56233 - DNA, 472 bp, Homo sapiens
  misc_feature 25, 45: n = A,T,C or G
tatatatggacagtgtaagatcatntagcctaacgggtgagagtntaggttctgaatccacatgacctgtgtgtgaatcccaggtctgccttgccgtagctgactggcagtttacctaatcttggccaaggaacttttttggacaagttacataatttctctatgcctccattttcattattcatagattgtgctgtagtttgttgaggataaaatgagttaatatatgtaaactgtttagaataatgcctgatacctgttattaatatctactgcttggaagtcagaaaaaaaaatcctatcacaaaggcaacagacactataaaattctttggaataaattttgcaagcatgctatgtgacctaatgtgagggtacctataaaatattatttaaaaaacgtaaaacaggacctaaataaataatcaatgtttttgggatgggaagatgataccataagaatattaattct

SEQ ID NO: 56234 - DNA, 144 bp, Homo sapiens
  misc_feature 23, 74, 125, 142: n = A,T,C or G
caactttcgatggtagtcgccgngcctaccatggtgaccacgggtgacggggaatcagggttcgattccggagnagggagcctgagaaaacggctaccacattccaaggaaaggcagcagggccncccaaaattacccccantt

SEQ ID NO: 56235 - DNA, 350 bp, Homo sapiens
  misc_feature 16, 316: n = A,T,C or G
tatggcggggaaccangacagacctattttcatgtcttatttctttaaagagctgcttcattgggcgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcaccgcgccttgtaatcccagctacttggggggctcaggcaggagaattgcctgaacccaggaggcggaggttgcaagtgagctgagattgggccacttgcnctccaccctgggcgacagagtgagactcggtctc

SEQ ID NO: 56236 - DNA, 431 bp, Homo sapiens
  misc_feature 23, 24: n = A,T,C or G
gacaaacctgagaaaaacaagcnnggggaaaggattccctatttaataaatggtgctgagaaaactggctagccctatgtagaaagctgaaactggatcccttccttacaccttatacaaaaattaattcaagatggattaaagacttaaatgttagacctaaaaccataaaatccctagaagaaaacccaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacttacagaatgggagaaaatttttgcaacctactcatttgacaaagggctaatatccagaatctacaatgaactcaaacaaatttac

SEQ ID NO: 56237 - DNA, 418 bp, Homo sapiens
  misc_feature 2, 20, 27, 37, 51, 55, 74, 77, 78, 104: n = A,T,C or G
tnctattttttatggtgggngaattcntctccctctntacaaccctctctnttancgcttcttctttcttgggntgnncctgactgctgacatggcgtgccctntggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcttctgatgtgggttg

SEQ ID NO: 56238 - DNA, 458 bp, Homo sapiens
  misc_feature 12, 21, 34: n = A,T,C or G
ggataccaaagnaagcaaagnagaagtaatgctnttattggggcgtgcatcagtggacatgtgctaaccagtaagaacagcaggaggcctaaatgcccatgtttagggagagaatatggaaaaaatggatgggattatttggaaaagatgtaagagattaaaatacgtggtaagagctacctcaactcttgtttttctccttttccatagataaagacctgaacaaactgaaaaggtaggacgtaaagtaggaattgtaaaacggaaatactctttatataagaaagctctactgtatgtcagaaagcaatgtaatagatagaccaagcacagtggctcacacctataatgccagcactttgggaggccaaggctggaggattgcttgagtctaggagttcaagccgagcctgggcagcatagtgagaccccatctctacaaaaaataaacagaattt

SEQ ID NO: 56239 - DNA, 262 bp, Homo sapiens
ctctgctcgacaaccaggttggcttcaaaaatatgcagaatgtggagcacgtccccctgacgctggacagagccatgaggctggtgaaagatgtcttcatttctgcagccgagagggatgtgtatacctggagatgctctcaggatctgcatcgtgaccaaagagggcatcagggaggaaactgttcccctgcggaaagactgacgtgcgggtcatatattggagctgtggcacagtttgttttattaaaaagaatgtaaag

SEQ ID NO: 56240 - DNA, 500 bp, Homo sapiens
  misc_feature 64, 402: n = A,T,C or G
ccaacgaagaatagaaatctgctctctgttgcctacaagaaatgtggtaggcgccccgccgttnttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctactttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggnctggcactaaatttctcagtcttttactatgagattctaaactctcctgaaaaggcctgtagcctggcaaaaacggcatttgatgaagcaattgctga

SEQ ID NO: 56241 - DNA, 400 bp, Homo sapiens
  misc_feature 11, 19: n = A,T,C or G
attgctaaatncagcattngaggccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattggtttatcataaaacatattatgttcctagttttaaaaaga

SEQ ID NO: 56242 - DNA, 206 bp, Homo sapiens
  misc_feature 15, 22, 27, 31: n = A,T,C or G
tgactagtgttaggnttagcanaaggnaggnttgttggactttgtctagattgaagaggaaacatggtcctacacgtacctattgctaggccttcatctggatacatgcaaagtatctctgccttgattctcttcaacaacaacagattgtaaggagagagagagataagataatttgcaaatctcttgtcactccccttttcttg

SEQ ID NO: 56243 - DNA, 372 bp, Homo sapiens
  misc_feature 9, 10, 27, 29, 46, 50, 57, 65, 86, 291, 336: n = A,T,C or G
ctcatgttnngaaatgatatgaccttnantttaagtaggaaagtcncccnaacactnctgctttnacttaagtgtctggcccgcantactgtaggaacaagcatgatctcgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgnggaaagacaactgttttaataaaagatttacattcc

SEQ ID NO: 56244 - DNA, 464 bp, Homo sapiens
gcaaatgtattgattacaaataaacagttgtttcttagcaagacctgaaaatatgtctgcaggtttctccttgaagcaaatgtgtgggatcattgcatttccagaaatctgcctccttcaccctccgttgacagtatatgtcattgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccagtttcttatccacaaagtactcctcacttt

SEQ ID NO: 56245 - DNA, 500 bp, Homo sapiens
  misc_feature 6, 7, 29, 41, 56, 427: n = A,T,C or G
cccggnntttatggtcgcgggaaacattnacttgggagccnagagctgggtaagcnttacctttagtactactctgtgactacagaaataaagccagcacttttggaactaataagccttcacttgtcagtatcataaagagtattgcccaactgaactttgctcccactggtttaatagttacttatttctgcctaagcactcaccttccgattttacccaagtatatatatagggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggnaataaagggctttttgaggggggtatggatattaaatgttttcgttatatacttatccctattaaaacaggca

SEQ ID NO: 56246 - DNA, 417 bp, Homo sapiens
  misc_feature 1: n = A,T,C or G
naagacgtatgaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatccctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaacg

SEQ ID NO: 56247 - DNA, 271 bp, Homo sapiens
  misc_feature 24, 28, 31, 83, 249: n = A,T,C or G
ccttaatcagtgtgatagtgaaangcgngtncaacctcataggactgattatataatgaagttgtttgagagtatatatacgnggtattgttttattaaacttaaactcaaataatattttgattaaaatttttaataagactttattgctagaaaattctttgagctttgaatcaccagggcaaaaatgactttcaactaaccttgtgaatcttttgcagtgtactgtgtgcaataccaagggcatanctccctgtaatttgggaaatac

SEQ ID NO: 56248 - DNA, 319 bp, Homo sapiens
  misc_feature 9, 27, 265, 271: n = A,T,C or G
cttagaggnggggagcagagaattctnttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggntgtggntaatctggtttatttttgttccacaagttaaataaatcataaaacttg

SEQ ID NO: 56249 - DNA, 490 bp, Homo sapiens
  misc_feature 3, 7, 31: n = A,T,C or G
ggnttcnaaagtatgagaaacacagtttgtnttctccttttatccaagcaggaagattctatatcctgatggtagagacagactccaggcagccctggacttgctagcccaaagaaggaggatgcggttaatctgtttcacctggtttgtcctaaggccatagttaaaaagtaccagctctggctggggtcccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgct

SEQ ID NO: 56250 - DNA, 331 bp, Homo sapiens
  misc_feature 32: n = A,T,C or G
gtgtgacttcattgagacacattacctgaatnagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaag

SEQ ID NO: 56251 - DNA, 404 bp, Homo sapiens
  misc_feature 17, 33: n = A,T,C or G
caaagcacgaacttttncaccgaaaaaagagcntggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaaga

SEQ ID NO: 56252 - DNA, 197 bp, Homo sapiens
  misc_feature 6, 196: n = A,T,C or G
caatgncaaagtaaatgcacttcatcaaagtcttagaagtcacaggaattgttctcaggtttttaaaaaaatttttcctgaattcaggaagtgtcttctgaatagcagctagccaaataaagcggtgtgtgtgtactgcagctgtaggtgaacttaaaaataataataaaaagaacaaataaagcagtgtgtaccng

SEQ ID NO: 56253 - DNA, 415 bp, Homo sapiens
  misc_feature 6: n = A,T,C or G
ctgaangactgaataatttggctaagttggtattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgcc

SEQ ID NO: 56254 - DNA, 490 bp, Homo sapiens
  misc_feature 24, 28, 31: n = A,T,C or G
acgtctttgaagttgtggctgagnaagnatnttaggaatatttaaataacatcaacagcaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattaca

SEQ ID NO: 56255 - DNA, 500 bp, Homo sapiens
tatggccgaggaatgtcataattagtaattggtaatgtccatttaatataagattcaaaaatccctacatttggaatacttgaactctattaataacggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcgtaacaaaaaagtaagatattcggtatttaacactttgttatcaagcatattttaaaaagaactgtactgtaaatggaatgcttgacttagcaaaatttgtgctctttcatttgttgttagaaaaacagaattaacaaagacagtaatgtgaagagtgcattacactattcttattctttagtaacttgggtagtactgtaatattttt

SEQ ID NO: 56256 - DNA, 490 bp, Homo sapiens
  misc_feature 6, 31, 32: n = A,T,C or G
gggcgngccagtttataaagggagagagcanncagcgagtcttgaagctctgtttggtgctttggatccatttccatcggtccttacagccgctcgtcagactccagcagccaagatggtgaagcagatcgagagcaagactgcttttcaggaagccttgggcgctgcaggtgataaacttgtagtagttgacttctcagccacgtggtgtgggccttgcaaaatgatcaagcctttctttcattccctctctgaaaagtattccaacgtgatattccttgaagtagatgtggatgacttgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaattttttt

SEQ ID NO: 56257 - DNA, 490 bp, Homo sapiens
gaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctc

SEQ ID NO: 56258 - DNA, 490 bp, Homo sapiens
  misc_feature 31, 33: n = A,T,C or G
ggattcttcccctctctacaaccctctctcntnagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaaactgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttccaccctggctccttcagacacgtgcttgatgctgagcaagtt

SEQ ID NO: 56259 - DNA, 490 bp, Homo sapiens
  misc_feature 32: n = A,T,C or G
ggggccttcctgaagctgacagcattcgggtngagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacactt

SEQ ID NO: 56260 - DNA, 490 bp, Homo sapiens
  misc_feature 5, 20, 31: n = A,T,C or G
gcggnctgaagaacataagnaatgaaaaggntttggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgccctcactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 56261 - DNA, 200 bp, Homo sapiens
aactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttccgtctgggagagggaaaacccctcccagggcaaaaggaactaagaccaggggtgggc

SEQ ID NO: 56262 - DNA, 261 bp, Homo sapiens
ctaagcccgggggtctgatgcagtccgacctgagtgagtggagctgtgtccgcacctcggccaaggctgacattattgcaccgacctctggcgcggagcctgaggccctgaactgccttcagtgccaacacatcgcttgagcttctgcctctctggaggcccaggagtggtccgatccccggagcgctccaaaattccgttaggaacaacactgcatccctctccctaccctctagctgtctttatgggataagtttttat

SEQ ID NO: 56263 - DNA, 388 bp, Homo sapiens
  misc_feature 17, 40, 41, 43, 386, 387: n = A,T,C or G
tatggcgcgggatatgngggtagaatatactatcttttanntnttacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaacctttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaannc

SEQ ID NO: 56264 - DNA, 310 bp, Homo sapiens
  misc_feature 30: n = A,T,C or G
gggtgcacgccaggctcctgtctgtgctcntgggcctgtttcctggcctccccagatgaggaaactgaggcacaaaaaggtgaagtcctgagctcacagtcatgcaaccagcaggtggtgaaacacacctccaagctgcctgcctcctaagcatcaagctttgtggcccagggtgagaacagatttttgtttttccaggtggatatttgaaagggaggagctaagatctacttcatgctccaaatattcatggaccttcccaggacctcaacaaaacaaaaccatgaagaaaaaccttgacatgaacccc

SEQ ID NO: 56265 - DNA, 237 bp, Homo sapiens
  misc_feature 32: n = A,T,C or G
ggaacctttgacattgccttgtaatgaggtanttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaata

SEQ ID NO: 56266 - DNA, 345 bp, Homo sapiens
  misc_feature 7, 11, 34: n = A,T,C or G
aaacctncagnaaacagtacttaggtaattgttnggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 56267 - DNA, 419 bp, Homo sapiens
  misc_feature 30, 33, 57: n = A,T,C or G
aaagacgagattaatacaactacttaaaanttntagtcaataggttactaagatatngcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaagaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggaga

SEQ ID NO: 56268 - DNA, 290 bp, Homo sapiens
ctgaaccctctgggcctgcgctaattgtaagagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaaga

SEQ ID NO: 56269 - DNA, 235 bp, Homo sapiens
ggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcat

SEQ ID NO: 56270 - DNA, 232 bp, Homo sapiens
cacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacc

SEQ ID NO: 56271 - DNA, 376 bp, Homo sapiens
  misc_feature 20: n = A,T,C or G
aactcacagcttctccaagncatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaacatctttctcttacctgttat

SEQ ID NO: 56272 - DNA, 160 bp, Homo sapiens
gactcgaagatgagatctcattctaggagtgcttgctagtgcctccttcagggaccaaccctgtcaagtgggaaggcatgaagttcaagaagtcagcattcccagaggcagaaaagggtcccaatccagaccccaagagaaggttcttggatatcacaca

SEQ ID NO: 56273 - DNA, 300 bp, Homo sapiens
gcttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgttaaagttgaacgagctgatggatatgaaccaccagtccaagaatctgtttaaagttcagacttcaaatagtggcaaataaaaagtgctatttgtg

SEQ ID NO: 56274 - DNA, 219 bp, Homo sapiens
  misc_feature 7: n = A,T,C or G
tattacnagaaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtt

SEQ ID NO: 56275 - DNA, 314 bp, Homo sapiens
gttaaatgaattgaaaattctgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcacca

SEQ ID NO: 56276 - DNA, 181 bp, Homo sapiens
  misc_feature 13: n = A,T,C or G
attgccaaaagantgtgttttatggggagaaaactttttgaagtcctgccatgccttgcacaaatgtggggaaatctggaggtcttgagtcacccctctgtttattctggaacagagggcgaaggggtcaccgggcacttctcacagactttctagtgaacaaaaggtgcctattcttttt

SEQ ID NO: 56277 - DNA, 375 bp, Homo sapiens
  misc_feature 26: n = A,T,C or G
tgtcaaacagaatttttctttgaatnagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatt

SEQ ID NO: 56278 - DNA, 361 bp, Homo sapiens
ggaagaagtatcaaataatttgtgaacatattttaatactaccatatgagttaataaaatttaatacacgaaatttaacttaattattataaactggtgttaatatatttgtaaaatgtaggtatttaaagggaaactaagtctattaaagaagacaatgttttaatgttgttgctagcttgtttgcattttctgtcaccattttcacctcattctgtctattaaaaaattctatatatagtgctaaataaatgatgacttggcctatcttattatgtcaactaagaattgcatttgatacttacaacagacaataacaaaatcttatatagaagggatataatcttcctcacctaacaac

SEQ ID NO: 56279 - DNA, 113 bp, Homo sapiens
  misc_feature 10, 62: n = A,T,C or G
gcacatgganctttggaaaatatttttttcctttgcattcatctctcaaacttagtttttantctttgaccaaccgaacatgaccaaaaaccaaaagtgcattcaaccttaac

SEQ ID NO: 56280 - DNA, 365 bp, Homo sapiens
atacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcccgatggaattgttatactaggttaacatttgtaatttttttctagttgtaatgtgtatgtctgg

SEQ ID NO: 56281 - DNA, 373 bp, Homo sapiens
  misc_feature 3, 4, 11: n = A,T,C or G
ccnntttcagnaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttc

SEQ ID NO: 56282 - DNA, 370 bp, Homo sapiens
ttgaaacgatatacactatattatgtataaatgtatacacacttcctatatgtatccacatatatatagtgtatatattatacatgtataggtgtgtatatgtgcatatatacacacatgcacataacaaaatcagatgctcattacaaatccagatgctcattacaaaaccagatgctacacaaacagcagcagaggaaacaaggttggactcttgcaacagatcacaaaaaataaaaacagctacttgcagtgactttggtcatttctgtatgttcataaagaatggattgtaacaaggaaaaaaaggaacagtgttagtgaaaaaggaaaaatgggcgaaaccatcttgatccgatgcgaatgcagg

SEQ ID NO: 56283 - DNA, 363 bp, Homo sapiens
ggctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttc

SEQ ID NO: 56284 - DNA, 365 bp, Homo sapiens
catagagaaactctcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaag

SEQ ID NO: 56285 - DNA, 370 bp, Homo sapiens
ggcgggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaacgctctttgtccggggagatggcgttgtcctggttgcccctccactgagagttggctgaaacaaagaatttgtcctgtatggaaaacgggagactttgt

SEQ ID NO: 56286 - DNA, 112 bp, Homo sapiens
  misc_feature 18, 19, 32, 33: n = A,T,C or G
tattttcgctttctaaannaaagctagagatnnctgggcccagtggcatgtacctatagtctcaactactcaggagttcaagtccagcctgggcaacatattgagaccccgt

SEQ ID NO: 56287 - DNA, 374 bp, Homo sapiens
ggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcagg

SEQ ID NO: 56288 - DNA, 269 bp, Homo sapiens
gaaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaaga

SEQ ID NO: 56289 - DNA, 175 bp, Homo sapiens
caacccggaaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaacctta

SEQ ID NO: 56290 - DNA, 160 bp, Homo sapiens
gggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttacg

SEQ ID NO: 56291 - DNA, 382 bp, Homo sapiens
attcaaaagaaggtacagcctttggagttagacagagctgggtttttcttgacttcactgatatctgtgtttcaatttagaaagcctaatttcctcatttataaaatagatgtaatagtatatacctcacagggttggttggtacacgtattaagatcacgtacagttacatacttagcacagtgcctagcatagtaagcacttaataagtggtaactcttatttacacagtgcttctccaagcacctggtacatgactctatcaaatgcagttggctgggtccctctcccaaaaagtctaattctatcagtctgcggtgaggtccaaggatgtgcatttctaataagctcccaggtgatcctgaagctgcctgtccacaga

SEQ ID NO: 56292 - DNA, 138 bp, Homo sapiens
  misc_feature 17, 32, 104: n = A,T,C or G
taaggccggggaaaagngggttggagtgtgcnggatggctgatatggccagacctgcagaaaaacttagcacagctcaatctgctgttttgatggctacagggnttatttggtcaagatactcacttgtaattattcc

SEQ ID NO: 56293 - DNA, 219 bp, Homo sapiens
gatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacatt

SEQ ID NO: 56294 - DNA, 208 bp, Homo sapiens
acccgaaagcgactataaacgccggcgcctccgtccccagccgcggctcgggaatccacccgaagagtggctataaacgtccgcgcctccattgcgctctcctcttcacttaggacactggtcctcccacgcctgacaccgacgtcgccaggaccgcggggttgggggaacttggctgtcccacgtctttcaaataaagctgttttgt

SEQ ID NO: 56295 - DNA, 204 bp, Homo sapiens
  misc_feature 137, 173: n = A,T,C or G
tgaaagacatttcaaatctgtagcataggctagtgggcaggtccgcacagtcgaagccacacctggtctgttttctgtgcactgtagccttagtgtcacctttcttcttgtgtctccttatggtacactccagcggntgccttttttatcatttctactgaagttgggaaatncaaccccagaaattgacagatgaaaggagac

SEQ ID NO: 56296 - DNA, 127 bp, Homo sapiens
atattgcatgcagagtaaggacaactcacataattttagagcaaagagaaaatcaccactttcctcctccaaaatcccaggtctagggactttcttggccttctggagcctcatactatgtatacag

SEQ ID NO: 56297 - DNA, 320 bp, Homo sapiens
gggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacgc

SEQ ID NO: 56298 - DNA, 113 bp, Homo sapiens
cagcacggcgtggtgtgtccctggacacagctcttcattccattgacttagaggcaacaggattgatcattcttttatagagcatatttgccaataaagcttttggaagccgg

SEQ ID NO: 56299 - DNA, 169 bp, Homo sapiens
gaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtga

SEQ ID NO: 56300 - DNA, 275 bp, Homo sapiens
gggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaatactgagttaaattaagcaaataccttttacaagtgaaaggaagaatttttcttctgccgtcaataaaaccattgtg

SEQ ID NO: 56301 - DNA, 362 bp, Homo sapiens
tgctgaaacccacagcccaagcagtccagattatataagcggaaagctaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctat

SEQ ID NO: 56302 - DNA, 186 bp, Homo sapiens
gtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaaggttatttcatttc

SEQ ID NO: 56303 - DNA, 135 bp, Homo sapiens
atttgcaagggaaagttgtgaggttttctgggaaaattcaaagtcttgacaacatctttgtataaaatcaagaaaaattacttgaatcaatagtgtcagtactggacaagtttgtacgtattggagatccagccc

SEQ ID NO: 56304 - DNA, 383 bp, Homo sapiens
atacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagt

SEQ ID NO: 56305 - DNA, 374 bp, Homo sapiens
atacgctggtttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgc

SEQ ID NO: 56306 - DNA, 374 bp, Homo sapiens
gatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatgggagattttaaagtagaaataaatatgtattccat

SEQ ID NO: 56307 - DNA, 175 bp, Homo sapiens
  misc_feature 25: n = A,T,C or G
tatggccggggggtataaaaattanacagtcaggtgctgcataatgatattttggacgtgatagtagtccctaggcttacaatggagctaaaaattccttgcacctgatgatgttttgacgatcttgaccctttgtcggcagagactaatgtatgtgtttttcttagtttttaac

SEQ ID NO: 56308 - DNA, 290 bp, Homo sapiens
atattatgatacatctatacaatggaatattatgcagccattaaaattgagatacaatacatatacattaacatggaattagtgcaacaataaattaagtgaataagtagactttaaaatatgtataaatgagcccatttatgtgaaattatacatatctaatatgcacatatatacattgagattcatgacaagttcatcaaactatttacagtagtgatctctagggtattagattcaggtgatatttattttcttcttagaccttttagcaatatttgaatatttac

SEQ ID NO: 56309 - DNA, 391 bp, Homo sapiens
aacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaat

SEQ ID NO: 56310 - DNA, 371 bp, Homo sapiens
  misc_feature 11, 15: n = A,T,C or G
gtttccagatnattnttctttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaac

SEQ ID NO: 56311 - DNA, 330 bp, Homo sapiens
  misc_feature 2, 12, 40: n = A,T,C or G
angccggtcaanatactaatatttgggaaggctttaaagnacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgtcgatcttttttttccttacagacacccataataaaatatca

SEQ ID NO: 56312 - DNA, 259 bp, Homo sapiens
gggggaaggtttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttg

SEQ ID NO: 56313 - DNA, 374 bp, Homo sapiens
gttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattgg

SEQ ID NO: 56314 - DNA, 273 bp, Homo sapiens
  misc_feature 5, 19: n = A,T,C or G
aaatncggcttttatggcnaggggggggaggcgggatgggacacccaacactttttcctttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtg

SEQ ID NO: 56315 - DNA, 279 bp, Homo sapiens
ggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcg

SEQ ID NO: 56316 - DNA, 374 bp, Homo sapiens
gtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatcctttt

SEQ ID NO: 56317 - DNA, 263 bp, Homo sapiens
catggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 56318 - DNA, 171 bp, Homo sapiens
gggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttacc

SEQ ID NO: 56319 - DNA, 391 bp, Homo sapiens
gggctgtagtggcttcgtcttcggtttttcttttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaagg

SEQ ID NO: 56320 - DNA, 376 bp, Homo sapiens
gaactgcgaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagat

SEQ ID NO: 56321 - DNA, 373 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaat

SEQ ID NO: 56322 - DNA, 157 bp, Homo sapiens
attgaggagaagtctggcatggagggccggaagaaaatgttcgagtctgagtcctaactgcccacttccccagtaccaccctagcattggggaagcacccaacatccagtctgggagtacttggcctcgctccaataaaggattcacatctctttcg

SEQ ID NO: 56323 - DNA, 220 bp, Homo sapiens
  misc_feature 218: n = A,T,C or G
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcntg

SEQ ID NO: 56324 - DNA, 367 bp, Homo sapiens
gttcacaatattcttgcagaaatggtgatggggggaatggtattggagacaaatatgaatgagattgttacacaaattgatgcacaaaataagctggaaaaatctgaggctggcttagcaggggctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgta

SEQ ID NO: 56325 - DNA, 364 bp, Homo sapiens
aagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatt

SEQ ID NO: 56326 - DNA, 175 bp, Homo sapiens
aacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttacc

SEQ ID NO: 56327 - DNA, 291 bp, Homo sapiens
aacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatc

SEQ ID NO: 56328 - DNA, 373 bp, Homo sapiens
gaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcg

SEQ ID NO: 56329 - DNA, 262 bp, Homo sapiens
gaactcaatctaaattaaaaagaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgccaacctttgtaag

SEQ ID NO: 56330 - DNA, 328 bp, Homo sapiens
  misc_feature 328: n = A,T,C or G
tatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctatn

SEQ ID NO: 56331 - DNA, 228 bp, Homo sapiens
  misc_feature 35: n = A,T,C or G
gtgatagctggttgtccaagatagaatcttagttnaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccc

SEQ ID NO: 56332 - DNA, 374 bp, Homo sapiens
ggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattc

SEQ ID NO: 56333 - DNA, 288 bp, Homo sapiens
  misc_feature 19: n = A,T,C or G
gatatcaaaaggctttgcncatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 56334 - DNA, 384 bp, Homo sapiens
tatggccgggtaccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtggg

SEQ ID NO: 56335 - DNA, 365 bp, Homo sapiens
ataaaaataacgatgaataccttgtggaaatgataaccattttcttagtaaaactctcaatgacagtttaatgctgttagaaacaaaatattttattctctcataacagagaacaaattatatttagtttattggtaagaatgcttttgatctgctatacacatttatgaagatattagctttttattcagatatggattttaaaacatcttttggcatattcctgcctttgtgctccttgaacttgtgaactcagctaacttatctctctagcatacttttttaggctcttttgtaaacatttcagttttggcatgggaataagacaaaaatccaactgtaatctcagagatgtaatgctctgt

SEQ ID NO: 56336 - DNA, 299 bp, Homo sapiens
gtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagt

SEQ ID NO: 56337 - DNA, 371 bp, Homo sapiens
ataatttttagcttagggcctggtggctaggtcggttctctcctttccagtcggagacctctaccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccaca

SEQ ID NO: 56338 - DNA, 366 bp, Homo sapiens
gttacatattttcttaatgtgggagtcaaagtgaagctacatagctaacaagtcttattcatttagtaagttggctgccctctgctgttcataatgtttcttaaacagattcgtttcctctaagagaagtttctatctccccttggcaaaacaaaatactattcttgaaaacagaagttataataattaatgatatcattcagtgtgtaacattagaaactatgaagtttaaaagagtcagaggttagttttcctgtagaagaaatagtatgtctctctaaacagaagagaaattactggaaattctctctcctgtcagttaccctaaaaaccagctccagcaaagccatttcacgaacaattatg

SEQ ID NO: 56339 - DNA, 365 bp, Homo sapiens
tgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaac

SEQ ID NO: 56340 - DNA, 227 bp, Homo sapiens
attttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttc

SEQ ID NO: 56341 - DNA, 285 bp, Homo sapiens
ggccgggcgcagtggctcacgcctgtaatcccagcactttgggaggccaaggcggtcggatccttggagatcaggagttcgagaccagtctggcaaacgtggtgaaaaccggtctctactaaaaatacagaaattagccgggcatggtggcccacgcctgtaataatgtcagctatgtgctgaggcaggaaaatcacttcaactcgggaggcagaggttgcagtgagctgggattgcgccactgcactccagcctggcagacagagtgagacttcgtctcaaaac

SEQ ID NO: 56342 - DNA, 373 bp, Homo sapiens
ggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaacta

SEQ ID NO: 56343 - DNA, 374 bp, Homo sapiens
  misc_feature 32: n = A,T,C or G
gggctaaataaaagccaattaatcctacaatnggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttc

SEQ ID NO: 56344 - DNA, 380 bp, Homo sapiens
  misc_feature 30: n = A,T,C or G
ccttatggccgggcaatggatttcaaaatnacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactggggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcc

SEQ ID NO: 56345 - DNA, 170 bp, Homo sapiens
aagataaaatttgaaatctggttaggctggtgttagggttctttgtttttggggtttggcagagatgtgtttaagtgctgtggccagaagcggggggagggggggtttggtggaaattttttgttatgatgtctgtgtggaaagcggctgtgcagacgttcaattgttag

SEQ ID NO: 56346 - DNA, 387 bp, Homo sapiens
  misc_feature 187: n = A,T,C or G
attgcaattgcagaacagaaagtgagaaaactttgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaancaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgt

SEQ ID NO: 56347 - DNA, 364 bp, Homo sapiens
gaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacattta

SEQ ID NO: 56348 - DNA, 376 bp, Homo sapiens
gaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactg

SEQ ID NO: 56349 - DNA, 368 bp, Homo sapiens
gcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagatt

SEQ ID NO: 56350 - DNA, 397 bp, Homo sapiens
cttttaaccacaatgaaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtacaaactatggtgaaaagtgccagtggtagtaactgtgtaaagtttctaattcacaacattaattcctttaaaatacacagccttctgcctctgtatttggagttgtcagtacaactcatcaaagaaaactgcctaatataaaaatcatatatatggtaataatttccctcttttgtagtctgcacaagatccataaaagattgtatttttattactatttaaacaagtgat

SEQ ID NO: 56351 - DNA, 363 bp, Homo sapiens
  misc_feature 16: n = A,T,C or G
gaagtaaatccaaagnagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaacttt

SEQ ID NO: 56352 - DNA, 185 bp, Homo sapiens
  misc_feature 185: n = A,T,C or G
gaaatattgaaactaagctacagtaccagtaattagatgtagaatcttgtttgtaggctgaattttaatctgtatttattgtcttttgtatctcagaaattagaaacttgctacagacttacccgtaatatttgtcaagatcatagctaactttaaaaacagttgtaataaactttttgatgctn

SEQ ID NO: 56353 - DNA, 301 bp, Homo sapiens
  misc_feature 6: n = A,T,C or G
agtggntaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcgaaaaac

SEQ ID NO: 56354 - DNA, 309 bp, Homo sapiens
gtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacgg

SEQ ID NO: 56355 - DNA, 461 bp, Homo sapiens
cattcctgagctgacagcattcgggccgagagtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgacttttgtcacagcccaagatagttaagtgggatcgagacatgtaagcagcatcatggaggtttgaagatgccgcatttggattggatgaattccaaattctgcttgcttgcttttt

SEQ ID NO: 56356 - DNA, 111 bp, Homo sapiens; identical to SEQ ID NO: 41933

SEQ ID NO: 56357 - DNA, 299 bp, Homo sapiens
ataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagccaacatagggaaaccccatctctacta

SEQ ID NO: 56358 - DNA, 484 bp, Homo sapiens
  misc_feature 11, 27, 32: n = A,T,C or G
gcaactaaagnaattagagaatcaagnagcantcaaacctcaaagcaagcagatggcaagaaataactaagatcagagtagaactgaaggagatagagacacgaaaaaccctttaaataatcaacaaatccagaagctgtttgcttttaattaataaaatagatagaaggccagctagaataataaagaagaaaagagagaagactcaaatagacacaatcggaaatgataagggagatatcaccactgaccccacagaaatatgaacaaccatcagagagtactgtaaacatgtctatgcacatacactagaaaatctagaagaaatggataaattcctggacacatacacccaaccaagactgaaacaaaaataaattgaatccctgaacagaccagtaatgggttctgaagttaaggcagtaataaatagcctatcaaccaaaaagagcccacgaccagacagattcaaaactgaattctg

SEQ ID NO: 56359 - DNA, 226 bp, Homo sapiens
  misc_feature 224: n = A,T,C or G
ataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacnct

SEQ ID NO: 56360 - DNA, 483 bp, Homo sapiens
cttgactgttaatattacaatgatagattcttgtccgaaatgtaacctaaaaaaaacaagtgacagacaatatttaaacagcaaacaaacttgttactaaatattcaactgaatgacccttaagaaggtgactaaaagcagttttaattaaagctgtcaagaagatagacaataaatttgattagaaagtgttcattgataccatctcagggactgtgtcaatttcatttaaaatgttatgtccactgacggtaagttcagtacttcctaatttcatctttagcaattttaaatcttttaaatattaacatttccaagtttgaatagctaattgtttgctgacctcttgtgttagctggtagtactacactgcctcaaagtaagctttaaaatactgagaatcataaatacctcttaaaaactgaagtgcaacataatgggtacataaagataattaaacaacatacttagcaaacaatgact

SEQ ID NO: 56361 - DNA, 384 bp, Homo sapiens
  misc_feature 358, 374, 381: n = A,T,C or G
aacagtagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtntcaatgacacttgatnaagaatntga

SEQ ID NO: 56362 - DNA, 317 bp, Homo sapiens
  misc_feature 5, 20: n = A,T,C or G
gtggnaaggagaaaccaaanaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagtttt

SEQ ID NO: 56363 - DNA, 401 bp, Homo sapiens
  misc_feature 6: n = A,T,C or G
gccagncagcagcaaggtctcagctaatgacgggaagtctttaaagtttgcgctgcatttcatcttctctgtgggagttttaggacgtctccagtgtttgatccctaccgtgcaactttgcttctagttaattaacagatcccccattacacactctcatctagaagcacatgggaggcctattgggaggtaattcaaggccaatctgagtgatggcaggaatgagagaaatcagttgttttagggctaacgttcaggaaagaaagatgtcccattttagggatctcatttgaaatttttgatgatttctcttttctattaaaaaacaagataggggaactgttttgtccacataaccttatgatgaccagtgagggcagtttgaacttagaactctttat

SEQ ID NO: 56364 - DNA, 414 bp, Homo sapiens
  misc_feature 6, 30: n = A,T,C or G
tgagcncatggttattactgatcgcattgntaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactg

SEQ ID NO: 56365 - DNA, 277 bp, Homo sapiens
  misc_feature 21: n = A,T,C or G
aatttactcaaatgatgaatnaaggtaagatcaattttttttaaatgcagataaatgaatagtatgactttcatagcagtgacttaaatttaaatgtacactctgaaggttgtgtgtggtaaaagtgtgtttatttagactgtgggggaaacaggtgctcttactctccagttagtcactgagctagataatactgtaatcccaagaaacgggcattgtaggccttttgtttagccctgttaatgcttcattctactaataaaactctagtaatagc

SEQ ID NO: 56366 - DNA, 387 bp, Homo sapiens
  misc_feature 7, 30: n = A,T,C or G
tgctgcngtgaacatgggagtgcagatatntgtatgatattatttcatctgggcatatactgaaaagaggggttgctaggtcatatagttattagacttttaattttttttgaggaacttccatactattttccataatggctgcaccagattacattcccacaaagagtgttcaaagattccctggaccttgtcttatataacatataaaaatgaactcaaaatagattgaaaacttaaacataagctctgaaaccataaaactcctagaagaaaaaatgtagaggaatacccccttgactatgattttttggatgtcacagcaaaagctcaggtatcaaaagcaaaaataaacaagtggggccacatcagtctaaaaagcttctg

SEQ ID NO: 56367 - DNA, 408 bp, Homo sapiens
  misc_feature 405: n = A,T,C or G
gtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttacttggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaanggg

SEQ ID NO: 56368 - DNA, 470 bp, Homo sapiens
  misc_feature 29: n = A,T,C or G
cctcatcgccgccatcatgggtcgcatgnttgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcat

SEQ ID NO: 56369 - DNA, 147 bp, Homo sapiens
aatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttt

SEQ ID NO: 56370 - DNA, 350 bp, Homo sapiens
  misc_feature 8, 27: n = A,T,C or G
atataggnccggggaaataccccaagncaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttatcggtaaagattgtataggcggatgcagtgatctagtctctttgcaacaga

SEQ ID NO: 56371 - DNA, 454 bp, Homo sapiens
  misc_feature 4, 452: n = A,T,C or G
aaanctattacccaatatgttaatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcagctggagaaaggtccacaggtgaggtttcttccaaggagcaatttctcttatttgactcttttgagatccttttctcacataattgtcaaatttcaattggagagaaactgtgttttctacctcattacggggtcagtgctgaggagagtaggaactcaggaaatgcttcttgattgactttagtctgctgtattgggtgacaaattgaccacagaccaaataacacgttggaatcctcttattctttctagagatctgggctgagaattaangg

SEQ ID NO: 56372 - DNA, 460 bp, Homo sapiens
  misc_feature 33: n = A,T,C or G
gaaggccttgaggcagcccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactactgagccccgaattaataccaatagaagggcaatgcttttagattaaaatgaaggtgacttaaacagcttaaagtttagtttaaaagttgtagggtgattaaaataattttgaaggcgatcttttaaaaaga

SEQ ID NO: 56373 - DNA, 477 bp, Homo sapiens
atcaacttcagaaggcagctccgtgatcctactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaaga

SEQ ID NO: 56374 - DNA, 464 bp, Homo sapiens
agaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggattgtagagccatatattgcatgggggggaccccaatctgaagtcagtaaatgaactaatctacaagcgtgg

SEQ ID NO: 56375 - DNA, 142 bp, Homo sapiens
  misc_feature 5, 30: n = A,T,C or G
cacgngggttcagctgtctcttactttttnccgtgaaattgacctgcccgtgaagaggcgggcataacacagcaagacgagaagaccctatggagctttaatttattaatgcaaacagtacctaacaaacccacaggtccta

SEQ ID NO: 56376 - DNA, 451 bp, Homo sapiens
  misc_feature 15, 18, 32: n = A,T,C or G
aagcttctacaattnganaatagcagtttcantgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttg

SEQ ID NO: 56377 - DNA, 490 bp, Homo sapiens
  misc_feature 7: n = A,T,C or G
cactgcnttttatttatttctcctgattctatatttttagtaatttgcttatatgtaaaagttgtttttgtggagtcagtggatatatttctaatgaagtgctagactatccaattacttaatttcttatacctttagataatcagtatgaaaagtccccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgt

SEQ ID NO: 56378 - DNA, 370 bp, Homo sapiens
  misc_feature 6, 14, 32, 34: n = A,T,C or G
gattgnacaggagnaagcaagcaggcgaatcntnatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgc

SEQ ID NO: 56379 - DNA, 490 bp, Homo sapiens
  misc_feature 30: n = A,T,C or G
gattcctgaagctgacagcattcgggccgntatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacact

SEQ ID NO: 56380 - DNA, 429 bp, Homo sapiens
  misc_feature 26: n = A,T,C or G
aggatcaaaaggacaagaatccttcnagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtccttttttataatgcagagtgagaactttccctaccgtgtttgataaatgttgtccaggttctattgccaagaatgtgttgtccaaaatgcctgtttagtttttaaagatggaactccaccctttgcttg

SEQ ID NO: 56381 - DNA, 420 bp, Homo sapiens
  misc_feature 25: n = A,T,C or G
agtagcttgtcaaagttgcagggcnagtgagtgacatttgaacccaggtatgcctaattccaaagcctaaccattttctacaacactgaaaatataatggatttttcccaaagtacaaaaacacccactgccctcagaccaccatgagccaataggaaatacacaatgctcaagaataacatactctttcccccaacgatgcaacatttggtggtaccagtttacgtctcttaaacacacagtgagaaatcctcactctactcacactctggtcattattaccctaaactcattgccttggagtctcaatcagcaactataatggctttttagatggaaatttaagtcatttagcaacacacagaaaagtgttggggagaagtccaaaaacatttcaaacttggcccatggccctttcta

SEQ ID NO: 56382 - DNA, 465 bp, Homo sapiens
  misc_feature 4: n = A,T,C or G
gacnaccattgatcctgtttgattttggagattatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttatt

SEQ ID NO: 56383 - DNA, 432 bp, Homo sapiens
ataaaagcaagcatttttatttccctttataatttctattcaatattgctagatatattaacatgaaggaatggggaagcttatttcaatgaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttc

SEQ ID NO: 56384 - DNA, 413 bp, Homo sapiens
acggtggcgtttccttgagaagagtgagggttccaacttttctgcttatctgggaggtgtttggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtg

SEQ ID NO: 56385 - DNA, 424 bp, Homo sapiens
  misc_feature 1, 29: n = A,T,C or G
ngaacattgtgaactgttatcccattgtnaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttacttggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctctattactgtaacaagtactcattaaaggaaattgaat

SEQ ID NO: 56386 - DNA, 404 bp, Homo sapiens
  misc_feature 4, 25, 32, 396: n = A,T,C or G
aagncctagtatttaagactgaaanaaggttnatttctaacctgtcataagaagtaacggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatctttttggacatatttttatattatttggaaaactttccaatattcctgttacaaagnggggtctg

SEQ ID NO: 56387 - DNA, 490 bp, Homo sapiens
  misc_feature 30, 32: n = A,T,C or G
aattgctaaaatatttaggtacaaataacntnactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaacctaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaac

SEQ ID NO: 56388 - DNA, 429 bp, Homo sapiens
  misc_feature 32, 33, 367: n = A,T,C or G
gctctcccggggacgttgtctgcaggcacttnnaatggtccagcgtttgacatatcgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcncagagtcagaaagctaaataaaaaaatgaaacttttttgagtaataaaaatgaaaagacgct

SEQ ID NO: 56389 - DNA, 210 bp, Homo sapiens
  misc_feature 205: n = A,T,C or G
atggccaagaatgaaaggaaagctggtgagcccctgttcagaaagaatgttacaatttcctccctggcaacatcagaatattcacctgagactgagatcctttgcaagtatgttggttgtgcctctgaagtatccttatacacacagtaaggttgaagcatggtcccaaaagccacggattaagatctccagcagcagccaaagnccaac

SEQ ID NO: 56390 - DNA, 490 bp, Homo sapiens
  misc_feature 7, 367: n = A,T,C or G
atggacngttctgggcataaatttaaaaaatgttgctaatgattaattattaattggggaaaagtactaatttgcaataatcacactttggatatagtttgtgagcttcccttttcctcatggggagaaataagtttggattgattggactgacagatgttgaaacaatttggttcagttagacaaattcttattgagttctaggacatatgggtaactgctgaataaatattcatttgttcatttattcagtcaacaaatatttattggatatccattgtctgccccacactgtgcaagttaccataatatatgtctgcaatcagacatttagatattgaaaatctaaacatgaatcttacatggntctcatcttcaatttgctttattacatgaccaaggatgagatcattgggtgattataaagcattgcagaaaagtaaatgatatgcttgtggacatttgaagaagggagtaatttattctgact

SEQ ID NO: 56391 - DNA, 477 bp, Homo sapiens
  misc_feature 1, 5, 32: n = A,T,C or G
ncagncgtttgatgaaattcaacatacttttntgatagaaaccctcaacaaagtaggatggaaggaagctacttcaacatcataaaggctatctatgaaaagcccacagcttacatcatacttaatggtaaaagactgaaagcttttcctgtaagaccgggaacaagacaaggatgcctgctttcactacttctgttcaacatagtattaattagacgttctagccagagcaattaggcaagaaaaagaaataaaagacattccaagtggaaaggaagaagtaaaagtatctgttagaagatgacatgaccttatgtgtaaaaactctaaagattctattttaaaaataacccaaaaagtgtcagaactaatgaatttggcaaagttagcaggatacagaatcaacatgcaaaaatcaattgcatttattttcatgtacaatgaacaattcggtaaggaaattaagaaaattccatt

SEQ ID NO: 56392 - DNA, 402 bp, Homo sapiens
  misc_feature 382: n = A,T,C or G
accctattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtgtaaaattggactgcatttcttagagtgttttactatagaccagtctcatgggccatctcttcctcagatgtaaatgatatctgggtaagtgttatatggaaanaaagtggacattttaaaact

SEQ ID NO: 56393 - DNA, 461 bp, Homo sapiens
aagaaaaacagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacag

SEQ ID NO: 56394 - DNA, 490 bp, Homo sapiens
aatctgcgggggagggagatggatgctcatttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggatta

SEQ ID NO: 56395 - DNA, 416 bp, Homo sapiens
  misc_feature 6: n = A,T,C or G
gagcanacatatgaaaatgctcaccagcaatgaaaaaaatgaccctatggcaaacaataaagtaaaatgctacactgtcttcctgtagaggacctactaggtttggacaaactggctgtgctcaaatacatgtgccaaaattgagcaggctgggtgcaaatattctaagggaattgaaagacactttttcgtgaaataggtttaggtgttgacattatctctaaaagtaattaaaagatgattgatgtagtaaattttcttttaagccatgcctttaagcacattgtaggaaaaggactgttaaacaccacattttcttatttagaacccttggggccataggtatttcacaatttaagaatcatttgcattttatgaagttaatatggtgtatataacatgtcctgtgtaactct

SEQ ID NO: 56396 - DNA, 384 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaaacttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttg

SEQ ID NO: 56397 - DNA, 420 bp, Homo sapiens
ataatagtatttattaaagaatcacaactgttaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatga

SEQ ID NO: 56398 - DNA, 331 bp, Homo sapiens
  misc_feature 6, 28: n = A,T,C or G
tgatancaaaaaattaatgaagaccagnaagttgtaatgactaaggccctacatagattaagtactcaataaatgcttgcatgagacaaatgaaaaatgtatttttaagaagcatttcttggtttcagtaaagcagatttttgttgttgttgccatcattgttagatgttgttattcctcagtcatgagtttctaaatggctcagtacctttaaaaaaagttatctaaatttagcctataatctcagcacattgggaggctgaggtgggtggatcacttgagctcacgaattcgagaccagcctgggcaacatggcaaaaccctgtctctt

SEQ ID NO: 56399 - DNA, 103 bp, Homo sapiens
  misc_feature 27: n = A,T,C or G
aagggtagataagcagccacaagtagnaaagttggaaaaaccatctggaagagggaataggattagcaaaggcacaatttcttgatgttagagatttaaattt

SEQ ID NO: 56400 - DNA, 235 bp, Homo sapiens
  misc_feature 17, 41: n = A,T,C or G
atggccgaggaaagggntcttcgacaattttgttctcaaantaagagataccaaaaagcagtctgagccactggaaataaccctacttgcccccgaacgcaccagggacttaacaggtctcagagaggctactgaatacgaaattgaactctatggaataagcaaaggaaggcgatcccagacagtcagtgctatagcaacaacaggtactgtaaataaacaggagagaacagag

SEQ ID NO: 56401 - DNA, 471 bp, Homo sapiens
  misc_feature 387, 391, 410: n = A,T,C or G
cttcgacgtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttgggtataattatggngggngattatttttttatactgnatgtgccaaagctttactactgtggaaagacaactgttttaataaaagattacattcctag

SEQ ID NO: 56402 - DNA, 474 bp, Homo sapiens
  misc_feature 1, 2, 12, 21, 32, 358, 388, 468: n = A,T,C or G
nntgacacatcngcacaaagnaagcaatcatntaataattctgaacacaaatttaatatctttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatctcattgaaaagaccgagccttgtatgtatgttatggatacataaaatgcacgcaagccattatctctccatgggaagctaagttataaaaataggtgcttggngtacaaaactttttatatcaaaaggctttnacatttctatatgagggggtttactggtaaattatgttatttttttacaactaattttgtactctcagaatgtttgtcgnatgctt

SEQ ID NO: 56403 - DNA, 369 bp, Homo sapiens
  misc_feature 2, 26, 210, 368: n = A,T,C or G
cntcgtttaatttatatgttatgttntaagccagcttctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactngtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagaaanc

SEQ ID NO: 56404 - DNA, 486 bp, Homo sapiens
  misc_feature 5, 7, 58: n = A,T,C or G
aaggncnggaagaggggaacatggacatgttttaggaggatccacctggagctgaggnaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagggagtgtcttcaagctcctgccccagcttacctacttggatggctatgaccgagaggaccaggaagca

SEQ ID NO: 56405 - DNA, 356 bp, Homo sapiens
  misc_feature 32: n = A,T,C or G
atgtaacgtgctgtgtagctaagtagcatgtngctggggggtgggatgatttagtaaattagtgaaacagagtagaaagttaaagaaaaaaacatgaggccaggcgtggtggctcatgcctgtaatcccagcactttgggaggccaaggtgggtggatcacaaggtcaggagatggagacccgtctctactgaaaatacaaaaaaatcagccaggcgtgatggcaggtgcctgtagtcccagctacttgggaagctgaggcaggagaatggcgtgaacccaggaggcagagcttgcattgagccgagattgcaccactgcactccagcctgggcgacagagcaagaccccatctca

SEQ ID NO: 56406 - DNA, 413 bp, Homo sapiens
  misc_feature 29, 31, 56: n = A,T,C or G
gagtcccgtgtgcagaagtcctggtaatntngtccttgttcccgtctggataccancttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagag

SEQ ID NO: 56407 - DNA, 404 bp, Homo sapiens
  misc_feature 31: n = A,T,C or G
aacgtcctacattttctgttgctatttaaantagaaagattggtgaccatggccacatatgttaacttgttgagcttttgtacagggaacaagtgtgacattttatattttcatatttatgacttatgaatatggcatctgtttctcagacactagattgatttcactaagtatttgagagactttgtaaaagaaaaacattctcgcatctcacaagctttaattgttttgtgcttggtcaagtattcatcttcttcttcatcaagctctgattcttccagcagttcttctgattctgaagatgaggataagaaacaaggaaaacggagaaagaaaaagaagaaccgttcacataaatcttctgaaagctccatgttagaaactgaatcagacagtaaggatag

SEQ ID NO: 56408 - DNA, 384 bp, Homo sapiens
  misc_feature 31, 44: n = A,T,C or G
atggcccgggcatcaacagcagtggacaagnaaggctgctgganctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 56409 - DNA, 348 bp, Homo sapiens
  misc_feature 30: n = A,T,C or G
acaggagtgagccaccatgcccggctggcngttgcatggaagagaacacctctttatggctcaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttt

SEQ ID NO: 56410 - DNA, 419 bp, Homo sapiens
  misc_feature 6, 11, 19, 27, 33: n = A,T,C or G
aaggcnccagnaggacagnacctgaangctaantagggacagatcagcgtccatggaaagcaggagcagaagccagtcttcttccaaacactggcacaaaccactgcctactggatacatttcaccagacaattcaccccagtgtccaagagtttatcttgcttctagaatatattgaaaagagccaccctctgaacaaatggcaaacactatatagtataaataggatgcactgaaaatagtaggcttatttcttaagctgtcatcacgaacattaaccagtaattatatttctccactttttgtagaagacataaatggcaaattctgaatttataatttctaatacttcatttttctgctcttgtaaagttcattttgaactttcaacataaaaatattaaatatttttaattgtg

SEQ ID NO: 56411 - DNA, 452 bp, Homo sapiens
  misc_feature 6, 31: n = A,T,C or G
gccttntatttagggtaaaattaacaaatcnttctattcctctgacccatgcttagtacatatgacctttaacccttacatttatatgattctggggttgcttcagaagtgttatttcatgaatcattcatatgatttgatcccccaggattctattttgtttaatgggctttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttatt

SEQ ID NO: 56412 - DNA, 489 bp, Homo sapiens
  misc_feature 8, 35: n = A,T,C or G
catatccnataaataaaaatacttctggagtattnaagtcactcaagtgctgtatcttccttctgcatttaagaaacttattatccaaatttaagacactttgaatttattttttgtccctctctgtgaaaagtaaaaatgccattctatgatatattccaacaaagaagaaatgagggtaacatttgttttaaaaggtttttaaaatttatctctacctcaatttttaaatctttcctattgtgtattactttctccctaaaataagggagttatacttaagtatttcctatgggctttttacatacctcgtaacttttcttgtacttggttttgattttccagcagaggtggtattagatgtgaaccttgaagcagagggcattggtgggaactgggattggaaaagaaggttatagccagacattgaagggcctttataccaagctaaagtttggatgttaacttcagaatatcagagagctaata

SEQ ID NO: 56413 - DNA, 490 bp, Homo sapiens
  misc_feature 7: n = A,T,C or G
taccacncaaaggactatgtgtgtgtatattataaaaagtatatatatacatacctttttctgaccttctcagtttcacctgcgtcaaaagcatcactttcagcgtgggaaagccattatgttaaaagccaacaccagacaactcttcctttctctgaaggcagttgcctttccctggagttagagtgtacaactgtaaaagcactgatggctagaggctaccttccttatctgcttaactgccaaaaatattttcatcagagatgcatgaagatggaacatcaatgaactcatctctaaataaatgtatcggtaaaattctggttcatgccaggcacaaaagtagcctaatcatatacacattatttaactcacagaccatctgaaggggctcgagaatatcactttgagaaacactcttcctaaaggatactgacagaggagttgtcaataactgagaaaaacgcctccattttagatttgtaacatc

SEQ ID NO: 56414 - DNA, 439 bp, Homo sapiens
  misc_feature 5, 7, 32: n = A,T,C or G
gtggncntagttgaaaattattgccgtcattntttacatacttaagacatattagccagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtat

SEQ ID NO: 56415 - DNA, 269 bp, Homo sapiens
  misc_feature 31: n = A,T,C or G
atctgaaatcccaacaaaaaaaatttaactncatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 56416 - DNA, 165 bp, Homo sapiens
tgtggcagcaataactagttcctatgaaagtaaccagagctgggaagatggctgggaagccaggccaaagtgggggcaacagcttgcttctctttctcttctcaccctcagtttgtatgggaaaatggagatgtcctctccactttatcccacgatatctaaatg

SEQ ID NO: 56417 - DNA, 347 bp, Homo sapiens
gtcgacaatcattttaatgaccaaaggtgctacttatttttcaacattgaccttgatcataagtgcttctatctgctgagctttatttattgtttttggacagaaagtttggtgggaaggttgcaataaaatcagaatctctcttgtctgaattatgcagtttaaccctgtccatgttcctctgtactctattcttactgtattttagttattgtttcttacttatcactaatttttactgcaggtctgtgctgtttcttagaaagtacatgcatatatatttctataatatgtaagaaaaaacctgtattgcttattaaattaaaattaaaataaaaaaattcatg

SEQ ID NO: 56418 - DNA, 395 bp, Homo sapiens
  misc_feature 5, 31, 171: n = A,T,C or G
atgtnctcattttattaaaacgtcaagtatntttctccctaccctaggccctccttgatcaaggtggattccctgaccttggtttccataaacatgtattcatccttcaaacctgatttttgaagttgctcaattgataaaaggaaagcatagacgtttataataccttangcactttatacccaaaacttgctgaagctgctactcatcagaatctaccagctgacctcaccgtggcggggacagatcaggtttgctggtgtgcgtcataacgatgaggttacaggaatgaagagatgaaggcctgtggccaaggtcactgaaggccaggtcccctgcccttccagaccagctttctttcccttccctcatagtgtcttctagatgttagagac

SEQ ID NO: 56419 - DNA, 487 bp, Homo sapiens
  misc_feature 12, 27: n = A,T,C or G
tacaagagcagnaggatggctctgtcnttgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgccgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatg

SEQ ID NO: 56420 - DNA, 391 bp, Homo sapiens
  misc_feature 6, 21, 32: n = A,T,C or G
gacaangcaccttcacagaanattctgcactnatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaag

SEQ ID NO: 56421 - DNA, 464 bp, Homo sapiens
  misc_feature 29, 31: n = A,T,C or G
gtaggcccgggtggttgctgccgaaatgntnaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattat

SEQ ID NO: 56422 - DNA, 466 bp, Homo sapiens
  misc_feature 6, 443: n = A,T,C or G
gatttnggggcagatcctgactacactaagtcagggtttgacaaatgacagtccatcagacagatctggcccactacccatttttgtatcctgcaagctaagaatggttttatatttctaaatggttgaaagaatcaaagaatattgtgacacatgaaaattatatgatattcaaatttcagtgtccataaataaagttttgaaaacatgaatacaaacaaaaaacacctatttatgtttgacctgtggctgtctttgcactaccccagcagagttgagtagttgtagcagacaccacatgcccttgagcctaagatctagcactttacaaagtaagtttttctgttacttagagctgaaaataaaagcaatgtagagttacgcttttataagtatttcatgtttcagaaatgatgcatacagcaatttgtaggtggggtggntttttgcagtatatttatttttg

SEQ ID NO: 56423 - DNA, 117 bp, Homo sapiens
  misc_feature 31: n = A,T,C or G
gaatgcggtggctcatgctttgtaatcccancacttcgggaggccaaggtgggcagatcatttgaggttaggaattcaagaacagcctgaccaacatggtgaaaccccatctctacg

SEQ ID NO: 56424 - DNA, 238 bp, Homo sapiens
atgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtt

SEQ ID NO: 56425 - DNA, 243 bp, Homo sapiens
  misc_feature 17, 40, 98, 110, 136, 140, 167, 198, 208, 220, 234, 242: n = A,T,C or G
cctcacatttggatgantggcctaagggttttagcactgntcctccttttcttcaccctccccttttttcttctattaatcaagagaaacttccaagntaatgggatggncggatctcacaggctgagaactcgtncacnctccaagcatttcatgaaaaagctgcntcttattaatcatacaaactctcaccatgangtgaagagtntcacaaatcctncaaaataaaaagtnatgacttng

SEQ ID NO: 56426 - DNA, 288 bp, Homo sapiens
  misc_feature 14, 31, 288: n = A,T,C or G
atttgctttaaagnaaatgttagccaactcntggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacn

SEQ ID NO: 56427 - DNA, 381 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaagg

SEQ ID NO: 56428 - DNA, 473 bp, Homo sapiens
gttacagctaataaatgaattcagtaagctgcaagatacaaaatcaaatacaaaaataagttgtgtttctatacactaacaatgaactgagaaggaaattaagaagataatcctatttacaatagcataaagaaatacttcaaatacatttaaccagggaggcaaaagatttgtatactgaaaactctcaaacattgatgaaagaaattgaaatagacacagataaatggaaagatattctattttcatggattggaagaatcgataatgttaaaatgtccatactactcatataaacctaaagattcagtgcaatcactctcaaaattcccatggcatttctcacagatagaaaagctatcctaaaatttgtaagtaaccataaaagatcgcaactagccaaagcaatcttgagcaagaacaaagctggaggcatcatgctacctaatttcaaaatatactataaaactata

SEQ ID NO: 56429 - DNA, 359 bp, Homo sapiens
gacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcct

SEQ ID NO: 56430 - DNA, 425 bp, Homo sapiens; identical to SEQ ID NO: 24822

SEQ ID NO: 56431 - DNA, 357 bp, Homo sapiens
gggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatga

SEQ ID NO: 56432 - DNA, 392 bp, Homo sapiens
  misc_feature 5: n = A,T,C or G
gaagngatagaaggaaagagtgaggagagaatgccttttttaaaacatagaaatatattatgcagaaataccattctctagttataggttacttgaaaatacaattgaatgggccaggcgccgtggctcatgcctgtaattccaacactttgggaggccgagacaggcgatcacctgaggtcaggagttcgagaccagcctggccaacatggtgaaaccctgtctctactaaaaatacaaaaattagctaggtgtggtggcagacacctctaatcccagctacttggaagggtgaggtaggagaatcacttgaacccaagaggcagaggttgcagtgagccgagatcgagccactgcacttcagcctgggcgacagagcgagacctcatctc

SEQ ID NO: 56433 - DNA, 315 bp, Homo sapiens
  misc_feature 6: n = A,T,C or G
aacaancagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagg

SEQ ID NO: 56434 - DNA, 447 bp, Homo sapiens
  misc_feature 18: n = A,T,C or G
gaagggaaattagaaagnataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggtcctagcgttcttgcatgctaacctaaggtagaagattagcagcctgtttgcatgcagcccggatgctgcccctgacgtgaagcatgttctgggaggttgacccaacctcctttggctgtggcctcattcaccccgtcctgtctgtggcctcattcaccgtgatattaggttgaaaaagctggttgatgaacgggaatgcttattggaacagattaagaaactcaaagggcagctggaggagagacagaagattggcaaactagacaatcttcgatctgaagatga

SEQ ID NO: 56435 - DNA, 116 bp, Homo sapiens
  misc_feature 36, 84, 88, 99: n = A,T,C or G
attatctaagctgatatttttggcagtttttaaatnatatttcagtatttttgaaaataacatttatgataaaaaaaaaaaatntgtnctggccaggcncaggggctcatgtctgt

SEQ ID NO: 56436 - DNA, 316 bp, Homo sapiens
  misc_feature 31: n = A,T,C or G
aacagcttaaagtttagtttaaaagttgtangtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaaga

SEQ ID NO: 56437 - DNA, 107 bp, Homo sapiens
  misc_feature 7, 22: n = A,T,C or G
aatgaanagaaggcctgcgaanctgaaggaaaaatacgaaaagggtattgctgcatatcgagctaaaggaaagcctgatgcagcaaaaaagggagttgtcaaggctg

SEQ ID NO: 56438 - DNA, 382 bp, Homo sapiens
  misc_feature 5: n = A,T,C or G
attgntggagtgcctgtggaaataactgataaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatattttttttctgaatgaga

SEQ ID NO: 56439 - DNA, 469 bp, Homo sapiens
  misc_feature 16: n = A,T,C or G
gggactgatgaaaagnagaatgttgtgatttgagcttttataaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggttttttgtatgctataatatatgcttatgatttctaaaaattatgcagtatacacaaagggcataaagtcaaaaagcgtgtctccctctgtgactttattctcata

SEQ ID NO: 56440 - DNA, 460 bp, Homo sapiens
  misc_feature 16: n = A,T,C or G
tgaatatcttcccagnaggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatattgtgaga

SEQ ID NO: 56441 - DNA, 345 bp, Homo sapiens
  misc_feature 14: n = A,T,C or G
tgccaacaccaagnattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtctcactatgcgctgcccctgggccgcaagaagggagccaagctgactcctgaggaagaagagattttaaacaaaaaacgatctaaaaaaattcagaaga

SEQ ID NO: 56442 - DNA, 354 bp, Homo sapiens
  misc_feature 44: n = A,T,C or G
tatggcccggggaatagccagaaaaatttaaataccattatttnactttcaagattctgaattttatatagtgttagtgattttttaacatttaaattttcgaaagaaaaatatgcgatatcatcattcatatggttaatttaactcagctatgtggagacatataagaggagtctcatgtttatagatgagttgtccgagtttgttacctagtggtaaaatcatgtttttacatggtcatataagaatgtaagttcagtttttaataataccagactcccaaagagaagtcattgtgttataaaataaatttaggtttggtattatcagaatgttttatatgattgtaaatac

SEQ ID NO: 56443 - DNA, 337 bp, Homo sapiens
  misc_feature 6: n = A,T,C or G
aatccnaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttg

SEQ ID NO: 56444 - DNA, 403 bp, Homo sapiens
  misc_feature 231, 238, 293, 331, 345, 380: n = A,T,C or G
cattcctcactccaaaaacagcaggccatctttttatgcaaaagtcagcgtgacaatatacttcactggtgtacatcgtttactttttaactggcttcattttaggaataataaattcatcagaatccttgactgaattaaaatggtttttgttttttggttttttttttacccagacaactctagaaatgcggaccaaactacttcattttctcaaagggcataccttgngcattgnggcttatgatgagccatattaattgcctgttaaatatacactagcttgaacttanatgttaaatgttattattaccagcatttgtccttttgngaaatcagtatcanaatacttgcactctttaacacattctttataaaangtataaattattcagaactattt

SEQ ID NO: 56445 - DNA, 187 bp, Homo sapiens
tctaacataaaactttcagatgtagctgtttgattcaaggcctaggtggcttaccagcccaagtccccatgtttggactttcagctgactagctcatcttgggaatcatttggtcattcagcacatttaccaagtatttactatgtaggcatgttaaactccaataaaacatacagcattgaatcag

SEQ ID NO: 56446 - DNA, 298 bp, Homo sapiens
agagagtacatgttgaaaaaggatttacaggtatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatac

SEQ ID NO: 56447 - DNA, 444 bp, Homo sapiens
tatggccgaggaataacgggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggacgttgcttcagagtgtgaagtcaaatgcatgccaacattccagttttttaagaagggacaaaaggtgggtgaattttctggagccaataaggaaaagcttgaagccaccattaatgaattagtctaatcatgttttctga

SEQ ID NO: 56448 - DNA, 449 bp, Homo sapiens
  misc_feature 6: n = A,T,C or G
cagggnaaatatgtctgagtttattgagagtaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagtaagaaaatgtgtttgggcttctgaaga

SEQ ID NO: 56449 - DNA, 403 bp, Homo sapiens
  misc_feature 16, 18: n = A,T,C or G
ggtctcgaattcaagnanaaagtacggcaagttcctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtact

SEQ ID NO: 56450 - DNA, 333 bp, Homo sapiens
  misc_feature 42: n = A,T,C or G
tatggccagggaagtgacaccatcgaaaatgtgaaggccaantatccaagataaagaaggcatcccccccgaccagcagaggctcatctttgcaggcaagcagctggaagatggccgcactctttctgactacaacatccagaaagagtcgaccctgcacctggtcctacgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggga

SEQ ID NO: 56451 - DNA, 394 bp, Homo sapiens
gggaccacaagtttgacctgatgtatgcctaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtctta

SEQ ID NO: 56452 - DNA, 370 bp, Homo sapiens
  misc_feature 6: n = A,T,C or G
gggtangccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgtggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatacaaccca

SEQ ID NO: 56453 - DNA, 336 bp, Homo sapiens
  misc_feature 28, 29, 41, 65, 68, 71, 73, 107, 108, 183, 232, 242: n = A,T,C or G
gaagtctagaagagacaaacggtctttnntataaagcgaanaggagctgcagatataaaagaaanatncgnanggggagatattggaaacgctggtatcatggcttnnagtggaagagctcagagaaacgtgtgctaatatggaaggggaagatgaagagccctaaaaatggggggccgtgcngagatctcaattagaggctttgaaaggagacgttcagagtaaagacttnaactagaggntgaaaactcagtaaaagaattatggctctggaaaagttagaagacgctttcaacaaaagccaacaagaatgctactctctgaaatgcaatttag

SEQ ID NO: 56454 - DNA, 445 bp, Homo sapiens
  misc_feature 30: n = A,T,C or G
gaattgccagctgcgtttccgcggtcgcgnttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtattt

SEQ ID NO: 56455 - DNA, 500 bp, Homo sapiens
  misc_feature 10, 17, 30, 76: n = A,T,C or G
cttctttganctcaggnaaccctcggtccntttatggcccggggaatgaccacctgttaaaaatattgtctaaggntttcctgctttgagggtgaggttgaaatcaatgatttccaggtccatatgattccatgaattttgcagaaggaagggagaaaggacgtctattttaatcctttaaccttttctatattgtattcttgctataatgtgatacctgggggatctaggctgtaacacaatgttattgatgaaatggtattatagagagcaaacttttctcttgtagacttttatcctgaactagccttaactctgggaaaaagagccactaattctgacgccccagtctctgccaggttttcctctgagatccattagatcctttacaaatagagatttttttctcaactagctttcctaagtctgtggcccattgtgttttcacattacaaactatttcctttcatattcagaatgttttctgtatataatcacgt

SEQ ID NO: 56456 - DNA, 330 bp, Homo sapiens
ggaggtcgcagcttccactggcgcgggttgagttccctgttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctg

SEQ ID NO: 56457 - DNA, 304 bp, Homo sapiens
ggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttaccc

SEQ ID NO: 56458 - DNA, 440 bp, Homo sapiens
  misc_feature 6, 32: n = A,T,C or G
agcatnaggaaggaaaagataaaaggtttctnaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaagacgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaaga

SEQ ID NO: 56459 - DNA, 445 bp, Homo sapiens
  misc_feature 33: n = A,T,C or G
atttaaacttcaattttttatatttaaacttcnattttttagcagcagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacaatgagattgcctaccattttataggatatttactatgtatttataccgttaagacctctatgaatgaatgtatcagagaatgtctttgtaactaactg

SEQ ID NO: 56460 - DNA, 204 bp, Homo sapiens
cagtgcaagtgaccgacaaaattccgttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 56461 - DNA, 344 bp, Homo sapiens
atccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaattatggaagaaagtttgtacagggtaaatctatagacgttgcctgccatcctggctacgctcttccaaaagcgcagaccacagttacatgtatggagaatggctggtctcctactcccaga

SEQ ID NO: 56462 - DNA, 302 bp, Homo sapiens
  misc_feature 7: n = A,T,C or G
atttgcngaaattcttttggtgtaattttattttttcctctcaatatatataattggacaaacgctggcaaaaagaaaaaaatggtaagcaaaaaacccaagataaagtttcgaggacgtcaggccttttgaaatacaatgtcaaatgacacattgtacggtttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccg

SEQ ID NO: 56463 - DNA, 490 bp, Homo sapiens
  misc_feature 3, 17: n = A,T,C or G
atnacccaaacacaagnaataaaattcagtggttgagcagacacacaaatgagaaagagaaaggactcaagtgttgcctctgcaaaaaaatcaaaccacaatgataaacaataggaaagaaaggaaaaaaaggctatacaaaacaaccagaaaacaattaacaaaatgacaaaaataaatcctcacctaccgataataaccttgaatataaatggattaagtttctcacttatatagactgccttaatggagagaaaaatataacccaactatttgctgctcgtaaaaactcacttcacctgtaaagacgcataaagactgaaagtgaaggaatagtaaaatatatttcatgcaaatgaaaaacaaaaacaagcacgagtagctatagttgtatcaggtaaaatagactttaagaatggtaaaaacaacaaacaacaacgaagatgatcattatataatgacaaagagatgaattcagcaagaggatata

SEQ ID NO: 56464 - DNA, 465 bp, Homo sapiens
  misc_feature 30: n = A,T,C or G
atcctgaaaagggttttactacatctattnccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaactgaaaacagaaaacaaaaaacctctatgcaatctgagtagagcag

SEQ ID NO: 56465 - DNA, 462 bp, Homo sapiens
  misc_feature 31: n = A,T,C or G
gaaggagatgatgacccagttcctctacctnatgtgaatgcagcaatattaaaaaaggtcattcagtggtgcacccaccacaagggtgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagac

SEQ ID NO: 56466 - DNA, 154 bp, Homo sapiens
ggctccccagcacacattcctttgaaataaggtttcaatatacatctacatactatatatatatttggcaacttgtatttgtgtgtatatatatatatatatgtttatgtatatatgtgattctgataaaatagacattgctattctgtttttt

SEQ ID NO: 56467 - DNA, 462 bp, Homo sapiens
gggaaaaaaaaatgcagggaggtatttaacagctgagcaaaaacattgagtcactctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattacgataaaggacaaaataagctgtttgccacctc

SEQ ID NO: 56468 - DNA, 376 bp, Homo sapiens
attcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccat

SEQ ID NO: 56469 - DNA, 223 bp, Homo sapiens
  misc_feature 221: n = A,T,C or G
tgtaacgcctcaaagaactccatcacagatgccctgattatccctgcacagctgggctttgcccagttctggctctcccaaaccgtgctgcggcgagtaatcccgaatgtacggtggagtgagcagactgacccccaggaggcacaggaggcgtagcccccaggacccacgacacttttagggttccagaaaaaagttttcattctacataaaaaaaaaantt

SEQ ID NO: 56470 - DNA, 273 bp, Homo sapiens
  misc_feature 32, 154: n = A,T,C or G
aacatcttaacatgtagtctgtataaaaatanttaagagctattccacattaaaaaaaaaactcttctaaatatcatatggattttttctacttgtatcacatctcactttgaactattgcatttcacgttatcagtaacccaatgcggtttgnggctattgcattgggcagcacatgtccaaagagaatatgtagaaagagaaggaaggagagttgaggatgaacttttggggatacagttaggtattaagcagaggaagagaggcctaaag

SEQ ID NO: 56471 - DNA, 381 bp, Homo sapiens
  misc_feature 6, 30: n = A,T,C or G
ctatanaattatgtgtagttgttccgtacnattttattttcttcatttatttattcacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggc

SEQ ID NO: 56472 - DNA, 251 bp, Homo sapiens
ggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaatccactccatatttgggtcatggacagtaaaggcagttggattctc

SEQ ID NO: 56473 - DNA, 223 bp, Homo sapiens
  misc_feature 5: n = A,T,C or G
caaangatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccac

SEQ ID NO: 56474 - DNA, 465 bp, Homo sapiens
  misc_feature 462: n = A,T,C or G
ggagtccgagtggagagagcgagctgagtgtttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaaagaagttgatgaaatgatcagggaagcagatnttg

SEQ ID NO: 56475 - DNA, 459 bp, Homo sapiens
  misc_feature 6, 32: n = A,T,C or G
aactcngtggtggccactgcgcagaccagtanttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatacgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaaga

SEQ ID NO: 56476 - DNA, 394 bp, Homo sapiens
  misc_feature 6, 21, 31: n = A,T,C or G
atgtcnagcctatttcatagnaaaatagttnttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctaccctg

SEQ ID NO: 56477 - DNA, 109 bp, Homo sapiens
  misc_feature 12, 14: n = A,T,C or G
cttaaaacgagnanaggttagcaaatgatgtaaaagaagctttattgtctagttgtttttttcccccaagacaaaggcaagtttccctaagtttgagttgatagttact

SEQ ID NO: 56478 - DNA, 245 bp, Homo sapiens
atagtcccaagatgtatgaacattcatagtataagaatgatgaacattgagttgtttgaagaaaggaagaggttttggttttgtcatatgttgtttttttttcctgttcaaagtaatattagtctattgaagaggacaaggaacgggggacattatggagatatgtggagctgacgttgctgaagtttctctggttattttgtagcaataattttgaagaatgggttttatttaaaagaaattgt

SEQ ID NO: 56479 - DNA, 321 bp, Homo sapiens
  misc_feature 7, 58: n = A,T,C or G
ggaagcnaaacagtctttgaatatcgaacactcaaggctgtgagactacctattgtanatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaatt

SEQ ID NO: 56480 - DNA, 388 bp, Homo sapiens
  misc_feature 5: n = A,T,C or G
atgtncattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagcctagttgtctttcctaccttacaaatcatgttagttttatgatttgttccgcatgttttatgtttattgtaagaaatg

SEQ ID NO: 56481 - DNA, 195 bp, Homo sapiens
  misc_feature 31: n = A,T,C or G
cacacttcaaattttacatgaggggttcttnacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttt

SEQ ID NO: 56482 - DNA, 460 bp, Homo sapiens
  misc_feature 31, 456, 459: n = A,T,C or G
gaactcggtggtggccactgcgcagaccttncttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggnaana

SEQ ID NO: 56483 - DNA, 489 bp, Homo sapiens
  misc_feature 29, 30: n = A,T,C or G
actgacaaaaactcctggggccaaatctnnctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgca

SEQ ID NO: 56484 - DNA, 490 bp, Homo sapiens
  misc_feature 31, 32: n = A,T,C or G
gatgacgaagatgatgatgatgatgattttnntgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgata

SEQ ID NO: 56485 - DNA, 436 bp, Homo sapiens
  misc_feature 7, 399: n = A,T,C or G
ggctccngcccgtggatctcatcgaagatggcggcgcgatctgtgtcgggcattaccagaagagtcttcatgtggacagtctcagggacaccatgtagagaattttggtctcgattcggaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagnagatgttctttgatttctataatgtccctattcaaga

SEQ ID NO: 56486 - DNA, 432 bp, Homo sapiens
  misc_feature 7, 12: n = A,T,C or G
gtatacnatatnagaacttccattttatatactagtatctggctattagtattttacaggaaccatagttcttggtgactacactatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcaggg

SEQ ID NO: 56487 - DNA, 186 bp, Homo sapiens
gcacctttggcttctttttcttcatcttgtggaaatgcaagggtcattccggttctgcttccagtgatgggcgaatctgtattaactggtagagtgagggtggggggatatgtgccagcattgagtggcagggctgagttgggtgagttcgagttcatttcattttgggggggtctgctgtgtttc

SEQ ID NO: 56488 - DNA, 329 bp, Homo sapiens
  misc_feature 6: n = A,T,C or G
gtgtanttctaattatcctgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtacttgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacatt

SEQ ID NO: 56489 - DNA, 287 bp, Homo sapiens
gctgctggaatttggtacaaaatatgttttgtctattgaaaacatacacggtaaatggtgttgttaggtaggttctgtccagttcttagggacttttttcacgttatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgca

SEQ ID NO: 56490 - DNA, 162 bp, Homo sapiens
  misc_feature 161, 162: n = A,T,C or G
gtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgcnn

SEQ ID NO: 56491 - DNA, 358 bp, Homo sapiens
  misc_feature 5, 6: n = A,T,C or G
gtggnnggagagaaggagagcctgcagacttaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagagg

SEQ ID NO: 56492 - DNA, 216 bp, Homo sapiens
  misc_feature 211: n = A,T,C or G
ctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagatgatngaatg

SEQ ID NO: 56493 - DNA, 404 bp, Homo sapiens
  misc_feature 12, 31: n = A,T,C or G
atggtccaaagnatttttttttctttttctntataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaaga

SEQ ID NO: 56494 - DNA, 370 bp, Homo sapiens
  misc_feature 32, 366, 367, 369: n = A,T,C or G
gaaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcagtgctgnnana

SEQ ID NO: 56495 - DNA, 275 bp, Homo sapiens
  misc_feature 6, 30: n = A,T,C or G
tgcagnggctcacgcctgtaatcccagcantttgggatgccaaggtgggcagatcacctgaggttgggagtttgagaccagcctgaccaacaaggagaaatcccctctctattaaaaatacaaaattagctgggaaaggtggcacatgcctgtaatcccagctacttgggaggctgaggcagaggaaccacttgaaccagggaggcggaggttgtggtgagctgagattgtgccattgcactccagcctggccaacaagagcgaaactccatctc

SEQ ID NO: 56496 - DNA, 220 bp, Homo sapiens
  misc_feature 7: n = A,T,C or G
gaaggangaggatttcggtgaggaggccgaataggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgt

SEQ ID NO: 56497 - DNA, 189 bp, Homo sapiens
ccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtg

SEQ ID NO: 56498 - DNA, 390 bp, Homo sapiens
ggaagccaggtcacctttcaggacccagtaattagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaat

SEQ ID NO: 56499 - DNA, 484 bp, Homo sapiens
  misc_feature 7, 22, 32: n = A,T,C or G
ggaaatngaaatgtgggcaagnactgtctttnaatatagaacacagaatgtggcacgcttgcccatcatagatcttgctcctgtggatgttggtggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccattttcttcaatttatttcagtgtaatgaaaaaagttgctta

SEQ ID NO: 56500 - DNA, 275 bp, Homo sapiens
  misc_feature 31: n = A,T,C or G
ggaacagtcgctggtgtgacaaatcagtatnaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattat

SEQ ID NO: 56501 - DNA, 490 bp, Homo sapiens
ggtggccgacgggtcctccaagaagtttggtgcgcggaccggagtaccttgcgtgcagttatgtcggcgtcggtagtgtctgtcatttcgcggttcttagaagagtccttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcag

SEQ ID NO: 56502 - DNA, 101 bp, Homo sapiens
attcatttaatggtttctgtaaacatttttaagacagttgggatgtcacttaacatttttttttttgagctaaagtcagggaatcaagccatgcttaatat

SEQ ID NO: 56503 - DNA, 232 bp, Homo sapiens
taacacaaattgatttttagcacttacagctgccgggatgtagaatgaaagttaaaattttctaatggcagaaaatctgtcactcatagaaatactggcgactgtagaaactagcaacattagggtggtgacttgggatggtgttggcaaatacagcaaagaaaactgtggaattctcagtgatgtgaatttcattctttttctttgtataaaaagaaatttatatgacatt

SEQ ID NO: 56504 - DNA, 448 bp, Homo sapiens
gagagtactcatggaaaaggagttccctggttttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtatttgtttgcatccccttgccctcaataaataaagttcttttttagttcc

SEQ ID NO: 56505 - DNA, 473 bp, Homo sapiens
  misc_feature 472: n = A,T,C or G
ccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcana

SEQ ID NO: 56506 - DNA, 463 bp, Homo sapiens
  misc_feature 335: n = A,T,C or G
atttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatnttgatggagacggacaagtcaactatgaagaattcgtacagatgatgactgcaaaatgaagacctactttcaactcctttttcccccctctagaagaatcaaattgaatcttttacttacctcttgcg

SEQ ID NO: 56507 - DNA, 465 bp, Homo sapiens
  misc_feature 424: n = A,T,C or G
gcagcagcatttttgttcaggggtgtttatcagaagcattatttacaaaagcaaaaaattagaattgctcaaaatgtgttatgacagggtaatttttaaattatcacacatctttatgttgtttttcagataatcattattaaccatttctgaagaataattagtatcagagaataattgtcatagtatgttaagcgaaaaataacaataaagtattgttgcaggttttaaaaaaaaatttttgtgtgtgtgacagggtcttgctttgtcgcccaggccagagtgcagtgatgtgatctctgttcactgcagctttcgcctcttgggttcaagtgattcttccatctcagcctcccgaaggaactacaggcgcacatcaccacaccgggctaatttttttttgtatttttagtagagacagggnttcaccatgtggcccaggctggtcttgaacacctgacctca

SEQ ID NO: 56508 - DNA, 482 bp, Homo sapiens
  misc_feature 410, 435, 460, 476: n = A,T,C or G
gatgcggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcggggcttcttagatctacttatggttgatggagcacattgatttgaagtttcagatcttccaaagcactatttgttgtaataacttttctaaatgtagtgcctttaaaggaaaaatgaacacagggaagtgactttgctacaaataatgttgctgggttaagtattcatattaaatacatgccttctatatgggaacatggcagaaagactgaaaataccagtattaattgngtaattcagaatcataccaatcagngtggaacctcaaacattgcaaaagngggggcaatattcagngcttac

SEQ ID NO: 56509 - DNA, 393 bp, Homo sapiens
  misc_feature 371: n = A,T,C or G
taccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggnggggtgattattttttatactg

SEQ ID NO: 56510 - DNA, 462 bp, Homo sapiens
  misc_feature 32, 456: n = A,T,C or G
cagcctccaaaacataaaggaaaacaaaaatntcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtntatttg

SEQ ID NO: 56511 - DNA, 287 bp, Homo sapiens
  misc_feature 37, 42, 47, 112: n = A,T,C or G
gttgtggtcagcgtatcaggaaaccgggagcgcttgnagcanggctnaccaactgactgaagagcagattgcagaattcaaagaagctttttcactatttgacaaagatggngatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcgagaaaaatgaaagacacagacaggg

SEQ ID NO: 56512 - DNA, 380 bp, Homo sapiens
ctatggaccggggggagccacccatgccctgacccacacactttttacttgtatagatgatttttggcttggacataaaagccaagccacccatttgcttttaatccaaagaacatgtatagtttttgtacccagagactatgatttatattgattgcacttgcctgccatgatttagataagatttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattact

SEQ ID NO: 56513 - DNA, 369 bp, Homo sapiens
  misc_feature 369: n = A,T,C or G
cggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttan

SEQ ID NO: 56514 - DNA, 471 bp, Homo sapiens
  misc_feature 11: n = A,T,C or G
aactaccaagnacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaagggcacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctct

SEQ ID NO: 56515 - DNA, 371 bp, Homo sapiens
  misc_feature 14: n = A,T,C or G
agaaagcactgagnagttcaaccgcaaggtaaagtaacaagaagagaagtccggtgaagatggtgagaaagacacaaaggatgaccagacagagcaggaacctaatatgcttcttgaacctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatg

SEQ ID NO: 56516 - DNA, 467 bp, Homo sapiens
attacaaccttgcgctatgctttccggaggacactacacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacgg

SEQ ID NO: 56517 - DNA, 457 bp, Homo sapiens
aatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgagggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtg

SEQ ID NO: 56518 - DNA, 414 bp, Homo sapiens
atatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattg

SEQ ID NO: 56519 - DNA, 383 bp, Homo sapiens
  misc_feature 2: n = A,T,C or G
cnttcctgagctgacagcattcgggccgagatgtctcgctccgtggccttagctgtgctcgtgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 56520 - DNA, 368 bp, Homo sapiens
  misc_feature 10: n = A,T,C or G
gattctaagnatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactg

SEQ ID NO: 56521 - DNA, 434 bp, Homo sapiens
ataacatgctgtttaaagcagctgtttacaggatgtgtagtggtatgccccttgtcatatactcttagcatatctttttttcctttggttttgcatggcttttcttcaggtactgtctcggtatcattctgctaatcattgttacagaatggtgacttcatttgtgctaacagtacaacagcagatttgggtcaggcttaatctaagtgtcaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataat

SEQ ID NO: 56522 - DNA, 407 bp, Homo sapiens
  misc_feature 6, 31: n = A,T,C or G
gtatgnaaacagtgcagtaagttgaaaactnagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagataatttttaactttataaattgtatatgaacatgtaaatcttttaaaatgtacataaaatactgtatttttttaccttgtgtgtgatagtctagtcattgcatgtaaatataattta

SEQ ID NO: 56523 - DNA, 475 bp, Homo sapiens
agctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccaca

SEQ ID NO: 56524 - DNA, 316 bp, Homo sapiens
  misc_feature 3, 15, 29, 33, 37, 43: n = A,T,C or G
atngccgaataccancgctactgctgggngtangaancctganactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatg

SEQ ID NO: 56525 - DNA, 453 bp, Homo sapiens
  misc_feature 29: n = A,T,C or G
tatcggggaagcgctccgggcctggaatncctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttg

SEQ ID NO: 56526 - DNA, 379 bp, Homo sapiens
gtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttg

SEQ ID NO: 56527 - DNA, 249 bp, Homo sapiens
  misc_feature 8: n = A,T,C or G
tatggacnaggggcgacaaacctaccgagcctggtgatagctggttgtccaagatagaatcttagttcaactttaaatttgcccacagaaccctctaaatccccttgtaaatttaactgttagtccaaagaggaacagctctttggacactagaaaaaaaccttgtagagagagtaaaaaatttaacacccatagtaggcctaaaagcagccaccaattaagaaagcgttcaagctcaacacccactac

SEQ ID NO: 56528 - DNA, 231 bp, Homo sapiens
  misc_feature 2, 4: n = A,T,C or G
gncnccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgatgacttgttgccctgaagtacaataaaaaaaattcattttgct

SEQ ID NO: 56529 - DNA, 294 bp, Homo sapiens
  misc_feature 11, 32: n = A,T,C or G
tatcaaccagnagctaaaggatgacgaggttnctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtc

SEQ ID NO: 56530 - DNA, 475 bp, Homo sapiens
aaaagtgagcattcacatgcaaaacaaatgaatctagtcacagactttatacccttcacaaaaattaactcaaaatgaatcatagacctaaatgtgaaacataagattatctaaaagtcctagaagataacataggagaaaatctagatgaccttgtgttaggcaatgactttttaggtacaataccaaaggcactatccgtgaaaaaaaagtgttggtaagctggacttcattaaaattaaacttttttgttctgtgaaagacactgtctgcatgaaaaaacaagccaaagactgggagaaaatattttcaaaagacctaacagataaatatccaaatatacagagaaccctaaaactcaacaataagaacacaaacaacccgattctttaaatgtttctgaggacacttgaaaaaataaataaataaataaataaataaataaataaaaaatgagccaaagactctaacagac

SEQ ID NO: 56531 - DNA, 383 bp, Homo sapiens
  misc_feature 2, 25: n = A,T,C or G
cnttcctgagctgacagcattcggnccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 56532 - DNA, 490 bp, Homo sapiens
  misc_feature 5, 15, 32, 33: n = A,T,C or G
gcagnacatgtcagnaaacaagtctgattccnnttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagagacagataagtccataaaaggagttggaatattcaatacccctttttcaataatagagcacctagacagaagataaaccaggaaatagaagacttgaacaacattataaggcaaattgacctaaaagacatctatagaactttccacccaacatcagaatacatattcttctcgagt

SEQ ID NO: 56533 - DNA, 167 bp, Homo sapiens
  misc_feature 17, 18: n = A,T,C or G
cagcgcaagaattgatnngaaaactgtggactcacaaattttaccaaaaatcaaagctattcctcagctccagggctacctgcgatctgtgtttgctctgacgaatggaatttatcctcacaaattggtgttctaaatgtcttaagaacctaattaaatagctgact

SEQ ID NO: 56534 - DNA, 298 bp, Homo sapiens
  misc_feature 9: n = A,T,C or G
aattcaagnatggattaaagacttaaatgtttgttagacctaaaaccataaaaaccctagaagaaaacctaggcaataccattcaggacataggcattgacaaggacttcatgtctaaaacaccaaaagcaatggcaacaaaagccaaaattgacaaatgggatctaattaaactaaagagcttctgtgcagccaaagaaactaccatcagagtgaacaggcagcctacagaatgggaaagaatttttgcaatctactcatctgacaaaggactaatatccagaatctacaatgaact

SEQ ID NO: 56535 - DNA, 316 bp, Homo sapiens
  misc_feature 29: n = A,T,C or G
gattccctgggtgcctgaaagtgctctgncacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaattttttttgcaaattggttttatttttttgatgaagccgagcaactctgtccaaaaaggtttagtttgtactcggaaaccacaaagtagtctcaaagtattttagagggaatcgatattgatggcaaaag

SEQ ID NO: 56536 - DNA, 181 bp, Homo sapiens
  misc_feature 33: n = A,T,C or G
gaaacgcagttgtcataaactgggttcatgggnttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctctt

SEQ ID NO: 56537 - DNA, 359 bp, Homo sapiens
  misc_feature 2, 3, 76, 79, 85, 356: n = A,T,C or G
gnnccactaaaatttatttttcaaaaatttacttcacattattctatgtaagggatgacttgtcagtgttccaggngtntcttanctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagnggg

SEQ ID NO: 56538 - DNA, 297 bp, Homo sapiens
  misc_feature 11, 23: n = A,T,C or G
agagtcgaatnagtcaaataatncttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcagg

SEQ ID NO: 56539 - DNA, 222 bp, Homo sapiens
  misc_feature 6: n = A,T,C or G
gttatncagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgattta

SEQ ID NO: 56540 - DNA, 290 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggc

SEQ ID NO: 56541 - DNA, 270 bp, Homo sapiens
  misc_feature 31: n = A,T,C or G
caaaacttaagtaggaaagtcacccaaacanttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtggg

SEQ ID NO: 56542 - DNA, 376 bp, Homo sapiens
  misc_feature 32: n = A,T,C or G
ataattctataggttttgaattacaggttttnaatatataggttttgaaatgtataatgtcatgtatctaccattacagtgtaatacagaatagtttcactgccatttcatttttatctctatactccagtgcctagcacagggcttgcaaatgttccatgaatgtgcaataatatcccatctaaaattaaatatgagcaaaataaattcagtagtacagtacatttaaagaacaatatgctacaaccaaatagaatctctcctgggaataaaaaggatggtttaaaattagaaaaaagtgttaatgtatcccattagtctgtcagataagataaataataaaagacaatatataggagaaaaatcagaattcaga

SEQ ID NO: 56543 - DNA, 358 bp, Homo sapiens
gataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggtttt

SEQ ID NO: 56544 - DNA, 453 bp, Homo sapiens
  misc_feature 19: n = A,T,C or G
ataaaaaataatgcagggntggcttctagagctaattaatatatatgttcaaataaccaaaagcccattgaggaaaaatgtcacatgacagcaaataatcaatccagaccaatatgatcacactcgctgtgaaggtgagaaaacttcatctttattacgtttccccaagagacgcactgcatttgttctcttgaaaacacacagctcatgttctcctttaaaacacacatcctctttaaagtaacatacaaacatgccaatacaaggtaaaaagttacatcaggaattctcacatttcaaaaacatacagtaaacatcaaataaaaatttatttttataagaatttaggggaactatcatgtagctgtaagtgtagtacatatattaagtatcatagataaaaagagtgctcccttcagcagcacatgtaataatagatacaaagatttaaag

SEQ ID NO: 56545 - DNA, 484 bp, Homo sapiens
  misc_feature 3, 20, 368, 414: n = A,T,C or G
ganccagggtaatctcggcnttatggcgggggatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttgggtaagatataaaatggaaaaaggctaagtaatatgtgaatatcatatttttggaaaggtaaaaagtacatttgtatattacatatatggacataacttgggaaggatgaaagaaagtncagcctctcgggggggggattatgaatgatttttctccttttgctngttggatttttctatattcctaaaataacaccattattattgctagaataataaaagtttataaaaaagg

SEQ ID NO: 56546 - DNA, 411 bp, Homo sapiens
attcaaacgatcacattttaaattctgtacataacagtaagcgcactagtcaaaagacatttatgtttgaaatgtcatttagatcaaacacaagggtcaaagcccaggacaagtaaagttttatacttaaagagtactaaagggccagtgtgcagatgggtggattaaaaaaataaataaaataaaaaatagtactaaagggcttactttcaggcaaaagtgttcctgacgtaccaaaaagtaagatatagtttattttcatgcctccctgctcctagtaatgtatgttttgtgctgaactggcagctatcccaatgtgaaatgtattttgaatgtatctggtgtcatttttctattaagaccaagtataatgtttgtttgtaaagcaataaatcttgacttgaaatcagg

SEQ ID NO: 56547 - DNA, 287 bp, Homo sapiens
  misc_feature 9, 36, 39, 66, 80, 286: n = A,T,C or G
atggcgggngagggttggaaagtccaagccgtaganacntagtttcctttcttagctgatgtcttnggccagaacaccgngggctgttaacttgccttgagttggaagcggtttgattttacgcctgtaaatgtattcattcttaatttatgtaaggttttttttgtacgcaattctcgattctttaaagagatgacaacaaattttggttttctactgttatgtgagaacattaggccccagcaacacgtcattgtgtaaggaaaaataaaagtgctgccgtaanc

SEQ ID NO: 56548 - DNA, 468 bp, Homo sapiens
  misc_feature 18, 24, 51, 88, 184, 461: n = A,T,C or G
tgggcacagattggtgtnggtatnccggagatctgcacatcccacaccggngcaacagtttgccagctaaattcaaaaaactcctggngccaggaaaaattcagcacattctctgcacaggaaacctttgcaccaaagagagttatgactatctcaagactctggctggtgatgttcatattgngagaggagacttcgatgagaatctgaattatccagaacagaaagttgtgactgttggacagttcaaaattggtctgatccatggacatcaagttattccatggggagatatggccagcttagccctgttgcggaggcaatttgatgtggacattcttatctcgggacacacacacaaatttgaagcatttgagcatgaaaataaattctacattaatccaggttctgccactggggcatataatgccttggaaacaaacattattccatcattttgngttgatg

SEQ ID NO: 56549 - DNA, 203 bp, Homo sapiens
  misc_feature 3, 202, 203: n = A,T,C or G
gangccccagggcctgcatctgcaaaggggcgttggacaagtgcagctgctgcgcctgatgctgggacagccccgctcccagatgtaaagaacgcgacttccacaaacctggatttttttatgtacaaccctgaccgtgaccgtttgctatattcctttttctatgaaataatgtgaatgataataaaacagctttgactcnn

SEQ ID NO: 56550 - DNA, 499 bp, Homo sapiens
gtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatg

SEQ ID NO: 56551 - DNA, 489 bp, Homo sapiens
  misc_feature 4, 28, 55: n = A,T,C or G
gtgncagaaggaaactatgggagttgantttttggaagtggtgaagtcccagccncagtggaaagaatgcctcagtatttttctgatattagttaagtgaagacacttaggggccagactattaaggaatagaaatgaaaatcttaaatgactagaccaagactgtcttaagattaatattcaagtttatatatcctggcagtgttgacaagggtatagaaaactttcctgttactaggataataattataccattttattttagacaaatgtacttagtcaaagttcaaatttgctttacacagatgacatttgttatgttcaaaaaattgcaagtcttcaaagtaagtaatatttcagataactgaatcttttcatccaatgcaagacattctgatggaatagtttcttaaatgtgttaaaaattgctttcttaaaataatacttagagcatattttatagtcagtgctcattgttaaacacaattg

SEQ ID NO: 56552 - DNA, 332 bp, Homo sapiens
  misc_feature 6: n = A,T,C or G
atgtgngctttgtagagatttttaaaaatattagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttac

SEQ ID NO: 56553 - DNA, 342 bp, Homo sapiens
  misc_feature 4, 11, 30: n = A,T,C or G
atangcaaagnacgcttaaacatttcaggnctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttcg

SEQ ID NO: 56554 - DNA, 212 bp, Homo sapiens
  misc_feature 163: n = A,T,C or G
cctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcanacacgtgcttgatgctgagcaagttcaataaagattcttggaagtttta

SEQ ID NO: 56555 - DNA, 464 bp, Homo sapiens
  misc_feature 31: n = A,T,C or G
gattccgggtcagaattgccagaattgactnattctgtgaaaggtaaagatgaatcttttaagaatatgacaagcttctagcattttttaatagttgatatttgatagagatttgcacctatttttagccaccataaagactagtgaattaaagtaactttctgaatgtgcatttcctgtgtgtggagagataaaaagagaataccttttcactaacttcctgttctgtgattaagagatcctgtcaataaacattttttcctttaattggaaaatctgaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaaga

SEQ ID NO: 56556 - DNA, 202 bp, Homo sapiens
gagaccagcctcaacaatatggtgaaactccacctctactaaaaacacaaaattagctggacatggtggcgcacacccgtagtcccagctacttgggaggctgaggcaggagaatcacttgaaccccacaggcggaggttgcaagtgagctgagattgtgccattgcaccccagcctggacaacaagaatgaaactctgtct

SEQ ID NO: 56557 - DNA, 372 bp, Homo sapiens
  misc_feature 7: n = A,T,C or G
aaactanaggcatacatactgttatgtgatattaacaacaaaaatatgttaaatgattttacataatttttaaagaattttttaaaaatctaggccgggcatagtggctcacacctgtaatcccagcactttaaggaggccgaggcaggcagatcacctgaggtcggtagtgcgagaccagcctggccaacatggataaaccccgtctctattaaaaatacaaaaattagccgggcgtggtggcaggcgcctgtaatcccagttactcgggaggctgaggcaggagaattgcttgagcccaggagacagagattgcagtgagccgagatcaagccactgccctgcagcccaggcaacaaagcaagactccat

SEQ ID NO: 56558 - DNA, 500 bp, Homo sapiens
  misc_feature 17, 42, 410, 469: n = A,T,C or G
tatggccagggaaccgnggcccatgcgaagctttccactatngcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaaacagcctacaatctgtgaccaccacaagatgtgccctgatggcagctgaagtttgattcanatgggcacttttcttccccttccctgcctagtttccttttgttccttgagtccacgcanaattccattctctggtcagcagacaggctta

SEQ ID NO: 56559 - DNA, 445 bp, Homo sapiens
  misc_feature 135: n = A,T,C or G
catcggtccttacagccgctcgtcagactccagcagccaagatggtgaagcagatcgagagcaagactgcttttcaggaagccttggacgctgcaggtgataaacttgtagtagttgacttctcagccacgtggngtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacat

SEQ ID NO: 56560 - DNA, 476 bp, Homo sapiens
  misc_feature 3, 26, 28, 53: n = A,T,C or G
acnaaataaaattttgtgggctctcntngagcctcaaaggccatttatatttncatttcaatagaaggaaaaataaatcctactacttagaaatatgggacagaacctttctgtttgtacctcttcaaataaattatgaatcctgagctcaaaatttagttgaagagacaaaaagtatatttgaaaaataactaatacagggaaaaagttttaagtttaagctacaaatggtaaataaacaccaagggattgttactgaaatagtttttgaaaaggagacggaagtttccttgaagcaggactcttaagaaaaggcaagaaggaaagccgggcatggtggccatgctgcctgtaatcccagcactttgggaggctgaggtgggcagatggcttggggccagaagttggagacctgcctggccaacatggtgaaattccatctctactaaaaatacaaaaattagccgggcgtggtg

SEQ ID NO: 56561 - DNA, 309 bp, Homo sapiens
  misc_feature 6, 7: n = A,T,C or G
gtacanncctgacagagaagattcccgagcagttaatcatctttccaatccaggaggaacaagcatgtctctctgccaagatccatctaaactggagtgatgttagcagacccagcctagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagat

SEQ ID NO: 56562 - DNA, 162 bp, Homo sapiens
  misc_feature 158: n = A,T,C or G
tgaagtacctggccatcttgggcacgtgcgacgtttctggctggcaatcgggtgctggcccagcaggcagtcaagagaacagcacattagttccagaagaaagatggaaattctgaaaactgaatgtcaagaaaaggagtcaagaacaattcacagtntgag

SEQ ID NO: 56563 - DNA, 372 bp, Homo sapiens
  misc_feature 79, 252: n = A,T,C or G
aggaaaagaaaaaacataaaaagaaaacgcctagtacaaagtccaaattcttactttatggatgtaaaatgtccaggtngctaccagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgtngtctcacagaaagccttatcataaattccataattctaattaatttaccaagataatgtaattacatttggttttgtaaggtatacagcagtaatctcctattttggggtcagtttttca

SEQ ID NO: 56564 - DNA, 410 bp, Homo sapiens
  misc_feature 23, 197: n = A,T,C or G
tagtaccaagtttgtaaaatatnagaggatatttatatattgtttctacgacatggtcttgcatttatatctttttactacagtgatctgtgacagcagcagcttcatgttgtattttttttactgaaattgtaaaatatccatcttaaagacatcaactattctaaaaattgtgtacaggatattcctttagtggnggaattaaaatgtacgaatacttgctttttcaaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttg

SEQ ID NO: 56565 - DNA, 155 bp, Homo sapiens
  misc_feature 1: n = A,T,C or G
naaagggttaccattcatttaaaaagctaaaacctacaaaaagctttccagtttttttcaatcctgcttcaggaccaaattatcttgtgctaccaccagcttcttgctcacactagaaggggtttgtacaaatggaaaccctattttgcctttgg

SEQ ID NO: 56566 - DNA, 500 bp, Homo sapiens
  misc_feature 25: n = A,T,C or G
cgtgaataccaagtacctgctcaangttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtatt

SEQ ID NO: 56567 - DNA, 480 bp, Homo sapiens
  misc_feature 15, 17, 44: n = A,T,C or G
tatggccgggtacancnccctttatacactgttttttccatatntatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgtt

SEQ ID NO: 56568 - DNA, 165 bp, Homo sapiens
  misc_feature 23: n = A,T,C or G
ccactgttcaaagaaataaaagnaggatacaaacaaatggaagaacattccatgctcatgggtaggaagaatcaatatcatgaaaatggccatactgtccaaggtaatttataggtttcagtgccatccccatcaagctaccaatgactttcttcacagaattga

SEQ ID NO: 56569 - DNA, 463 bp, Homo sapiens
  misc_feature 13, 31, 48: n = A,T,C or G
gaaagccgacagnacgtaaacgtgttcaatnttttccttaccaccagnaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccatagggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatc

SEQ ID NO: 56570 - DNA, 396 bp, Homo sapiens
  misc_feature 33: n = A,T,C or G
atatgactcatagcaacacaaatctattgacgntagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatg

SEQ ID NO: 56571 - DNA, 157 bp, Homo sapiens
  misc_feature 105, 117, 157: n = A,T,C or G
aagaaaaaagataaatttaaacctgaaaagtaggaagcagaagaaaaaaagacaagctaggaaacaaaaagctaagggcaaaatgtacaaacttagaagaaaatnggaagatagaancaagatagaaaatgaaaatattgtcaagagtttcagcccn

SEQ ID NO: 56572 - DNA, 487 bp, Homo sapiens
  misc_feature 465: n = A,T,C or G
aaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccactttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggnggtccgcatccttggccctctg

SEQ ID NO: 56573 - DNA, 265 bp, Homo sapiens
  misc_feature 24: n = A,T,C or G
gaaactccatctaaattaaaaaanaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaag

SEQ ID NO: 56574 - DNA, 130 bp, Homo sapiens
tcaactgtgttctccctggcattcagagaggagggagaggaggaagaggaaggggagggaagcttcccaagagtagcctcaacctgtgcttctgtgcattattctgagaataaatttctgtttcaaactg

SEQ ID NO: 56575 - DNA, 335 bp, Homo sapiens
gtgctgcggcgctgcgtagaagtatcaatcagccggttgcttttgtgagaagaattcctcggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaact

SEQ ID NO: 56576 - DNA, 244 bp, Homo sapiens
  misc_feature 7, 31: n = A,T,C or G
gtgtgcnagaataaaaatatgttacctgctntgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagc

SEQ ID NO: 56577 - DNA, 120 bp, Homo sapiens
ctgactgctgcttgaatgttcttggaggctgtttcttatgtatgggttttttttaatgtgatcccttcatttgaatattaatggctttttccattaaagaataaaatattttggacaatg

SEQ ID NO: 56578 - DNA, 133 bp, Homo sapiens
  misc_feature 131: n = A,T,C or G
ccggcttctagaatgtagatccgcgagggcgtgagcttggactggacccactgctgattccctgcacctagcacagtgcttgccacaaagtgggctctcaataaatattatttgtccaaggaaggaatgantg

SEQ ID NO: 56579 - DNA, 168 bp, Homo sapiens
cattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 56580 - DNA, 400 bp, Homo sapiens
  misc_feature 25: n = A,T,C or G
gtatttatttctctcccttgccaanaagattttctaatactgctcgtaccagccagagaaagatccaaaacactactcagctctcttgcactgaggaaatttttccccctacattgactcctggcctacatcagccaaacttaaccttggtggggtttggatttgatagccaattagttctgtgctggttgaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcat

SEQ ID NO: 56581 - DNA, 496 bp, Homo sapiens
  misc_feature 483, 487: n = A,T,C or G
gcgggtgaaaaagttgagaagcccgatactaaagagaagaaacccgaagccaagaaggttgatgctggtggcaaggtgaaaaagggtaacctcaaagctaaaaagcccaagaaggggaagccccattgcagccgaacccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaaacccttcagtcagcacgtgagaaaactgcgagccagcattacccccgggaccattctgatcatcctcactggacgccacaggggcaagagggngggntttccctga

SEQ ID NO: 56582 - DNA, 117 bp, Homo sapiens
  misc_feature 27, 76, 78, 99, 114: n = A,T,C or G
ctccttcccccgctcccccaaaaattngaattttttttcaacactcttacacctgttatggaaaatgtcaaccttngnaagaaaaccaaaataaaaatngaaaaataaaaaccntgg

SEQ ID NO: 56583 - DNA, 368 bp, Homo sapiens
ctttttacaaaaggcagaccttttttaagctgtgtaacccacatagcctaaccacctggcagaatgactacgaataggggtcattgtgctggtaaaagcctctattacgactgtaagtaagttggatgttggcaaaattaaattgttacagtatttagagctgctgtagctgttccttcacaacataaaataggataaatgactagtacgtctttcaggtgggtggcaagcagaacatgcgtaatattctctacctggtctgtagctgtaactgtgatgtacagacaaagcaaaaattaaaagaacttatgaaaacaaatgcaatgatactaggatatacacttttgtatttttattcttatataagg

SEQ ID NO: 56584 - DNA, 394 bp, Homo sapiens
tgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatt

SEQ ID NO: 56585 - DNA, 220 bp, Homo sapiens
tataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccg

SEQ ID NO: 56586 - DNA, 435 bp, Homo sapiens
  misc_feature 7, 32: n = A,T,C or G
gatagcnctcagcaatacggaagtaatgtttnaaatatgcacaatggtatgaaccaacaggcatatgcatatcctgctactgcggctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctggaacaatttttaggttttttttgtactagaaaatgcaggcagtgttttcacaaaagtaaatgtacagtgatttgaaatacaataaatgaaggcaatgcatggccttccaataaaaaatatttgaagactgga

SEQ ID NO: 56587 - DNA, 392 bp, Homo sapiens
  misc_feature 138: n = A,T,C or G
aggatggttgcacgaaacacactggggaatggagcaaaacagtctttgaatatcgaacacgcaaggctgtgagactacctattgtagatattgcaccctatgacattggtggtcctgatcaagaatttggtgtggacngttggccctgtttgctttttataaaccaaactctatctgaaatcccaacaaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttc

SEQ ID NO: 56588 - DNA, 122 bp, Homo sapiens
  misc_feature 23: n = A,T,C or G
tgctggggtgtttatggcaagcncactttgacagacattattgtggcaaatgttgtctgacttactgtttcaacaaaccagaagacaagtaactgtatgagttaataaaagacatgaaccag

SEQ ID NO: 56589 - DNA, 128 bp, Homo sapiens
  misc_feature 4: n = A,T,C or G
aagnagaattacttcaaattgagttattcagaaaaactcaagatttaagttaaaaagtggtttggacttgggaacaggactttatacctcttttactgtaacaagtactcattaaaggaaattgaatg

SEQ ID NO: 56590 - DNA, 389 bp, Homo sapiens
  misc_feature 377: n = A,T,C or G
ataacaacaatatctctgtagttggatcaagtgacttctgcccacctggacacaacaccaaaaaggcttcttattcgggtgtgagtcttttcagcagcccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcanaatcatcttttg

SEQ ID NO: 56591 - DNA, 424 bp, Homo sapiens
  misc_feature 1, 6, 29, 31, 34: n = A,T,C or G
nttccntagaatgtgaagtgtttttttantnatnagccaagaactatgcctgtctttttttcacacctgtgattctttcagcaagttagaaggatagcaagagaatgtgcatccttccccaaaccccgaagacaggcagctttggcttaaatatgcttatttattttcaaaattagaaaataaacacattaatgtaaatatgttgagacagacaaagaaatttgtctgctacttaataaacacgcgatttatactttttgtcttctaattaattgtcgaccctgaataaggtggtacaactaaggcatattatggaaaactggcattattgcttaatgtaacatgagggattggaatttctttaaagtaattttaagatatgattatttagcagaaatattcactggagcattttacttttaga

SEQ ID NO: 56592 - DNA, 369 bp, Homo sapiens
  misc_feature 29: n = A,T,C or G
gaactcggtggtggccactgcgcagaccntacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatgaaagaactactgacaacgaagg

SEQ ID NO: 56593 - DNA, 378 bp, Homo sapiens
  misc_feature 6: n = A,T,C or G
gaggcnttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttggattaaaatga

SEQ ID NO: 56594 - DNA, 442 bp, Homo sapiens
ggcagcagttgagtgtcctgagagtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagtctacttgtctggtttatcccttacagaatattagtaaga

SEQ ID NO: 56595 - DNA, 400 bp, Homo sapiens
  misc_feature 5, 7, 28, 34: n = A,T,C or G
ggtancnaataaaagtaaaccaaacagnactatntttcacttaatgagtttcttaaagaaatatattttatggttgaaggaaaaactatgacaccaactgatgttgtgctgaatgtatattgaagaaatatttaagataagtatactttaaaaatgggtaggttaaagagacccaaactgaagtaaagtttctacatttcatttgaagtggtaaaatgtcagcaccactaggctgtgattagttatgtatatatatgataatactcacaatagtctctaagatgactacacaaattgataaattttaaaaagctataaataaatcaaaataaaattataaaaaagtattcaagttactcacaaaaggataagaaaaaaggaacagagaaataagacacat

SEQ ID NO: 56596 - DNA, 303 bp, Homo sapiens
  misc_feature 32: n = A,T,C or G
gaatgaccaaggggatgaagatgatgaggatnaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaaga

SEQ ID NO: 56597 - DNA, 202 bp, Homo sapiens
  misc_feature 202: n = A,T,C or G
aaggtgaaatctaagaaaaggaatctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacan

SEQ ID NO: 56598 - DNA, 359 bp, Homo sapiens
gaggcgcgatgttgacggggtcctaagtatggctgctgggcgaccacttcctgacagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagaggg

SEQ ID NO: 56599 - DNA, 432 bp, Homo sapiens
  misc_feature 5, 72: n = A,T,C or G
attgngaggcagatttaccatcatgtgactggaagatatgcagcttatcatgatcttccaatgtcttaaatnagtcaccagtaccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaaacaatattaaaccgcccaagcagtgtgccctagcagaggaaaatgcaacat

SEQ ID NO: 56600 - DNA, 292 bp, Homo sapiens
taggatagtgatcactgatggagaaaaggggtggaggtgcttctgcagtgtctaatgttccctttctttattgagctactaattacacaggtgtgttcactttgagaaaattcctcaaacggcacttagacggtttgtatacttttctgtacatctattacagttcagtatgtttacttctaaaatatagtgagggtaccttctgtgtactttctatatgctttaaattttccttgataaaaaggtagttaaaagagaaaactaatttgtggtattagaagcctggatagtg

SEQ ID NO: 56601 - DNA, 325 bp, Homo sapiens
  misc_feature 7: n = A,T,C or G
gatcaancaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 56602 - DNA, 318 bp, Homo sapiens
tatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttgctctattaaggaaagaagcaatcagtagagaattcaggatagttttgtttaaattcttgcagattacatgtttttac

SEQ ID NO: 56603 - DNA, 102 bp, Homo sapiens
  misc_feature 102: n = A,T,C or G
catcccctctgacagcactcgcaggcaaggggggtcgccgtggtcgccgtctgtgaacaagattcctcaaaatattttctgttaataaattgccttcatgtn

SEQ ID NO: 56604 - DNA, 351 bp, Homo sapiens
gaccctctcaataattctttttgaaggggtggctggccctaatctcaagtaattctcagaacctactaattgtaatacttcctctggtctccagctttgggccttggtaataattctagggtgaagaaaaatccagctggtcattttataccagtctcctaaagagtttaataatgctgccatgataataggtagttcattccgtttttatttaataagaatctcttttattatcttatgcttgctttgattaatagtagagtacattatgatgtttatccatttactcatataggtattcaacacataaatacgtagtttgtattatgttttaagcaatttaagtaaaac

SEQ ID NO: 56605 - DNA, 355 bp, Homo sapiens
gattttgaagaagaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttat

SEQ ID NO: 56606 - DNA, 303 bp, Homo sapiens
  misc_feature 43, 44: n = A,T,C or G
ctatggaccgggggaagacctctttgactgctgtagtactaanntgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctg

SEQ ID NO: 56607 - DNA, 256 bp, Homo sapiens
tctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagg

SEQ ID NO: 56608 - DNA, 444 bp, Homo sapiens
  misc_feature 6, 29, 30: n = A,T,C or G
gctctngtcatcctggctaaagagcagannaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattctta

SEQ ID NO: 56609 - DNA, 354 bp, Homo sapiens
  misc_feature 14, 32: n = A,T,C or G
gttcactttaaagnaattcagaaaaaatacantttcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatga

SEQ ID NO: 56610 - DNA, 211 bp, Homo sapiens
  misc_feature 203: n = A,T,C or G
ctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtncaataaat

SEQ ID NO: 56611 - DNA, 205 bp, Homo sapiens
  misc_feature 204, 205: n = A,T,C or G
ccagtagcagtctgctggccagccaagatgagacaaagcactgcttcatccaagctgctgacctcctcatggccgacttcaaagtgctcagtagtcaggacatcatgtgggccctgcacgagctcaaaggacactatgcaatcacccgaaaggccttttctgatgccattaaaaaatggcaggagctatcaccagaaaccagtnn

SEQ ID NO: 56612 - DNA, 346 bp, Homo sapiens
agatatttcggatgataatctacctcacttttcctgtggctatgttctgggtttccaatcaggccgagtggtttgaggacgatgtcatacagcgcaagagggagctgtggccacctgagaagccatgagtaaggaaccgagagcagaggagtagatggtttccttattgccttctcctggaagagtgaagcggatcccacgcggacccctttcttcaagagatagaggaattcaaagagaggttacggaagcggcgggaggagaagctccttcgcgacgcccagcagaactcctgaggcctccaagtgggagtcctagcccctcccctgatgaaatatacatatac

SEQ ID NO: 56613 - DNA, 429 bp, Homo sapiens
  misc_feature 30, 32: n = A,T,C or G
gactgccagttctctgggaagtggtcagcntntcctgcagggcttctcctcctctgtcttttggagaaccagggctcttctcaggggctctagggactgccaggctgtttcagccaggaaggccaaaatcaagagtgaggtgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggccggatctcacaggctgagaactcgttcacctccaagcatttcatgaaaaagctgcttcttattaatcgtacaaactctcaccatgatgtgaagagtttcacaaatctttcaaaataaaaagtaatgac

SEQ ID NO: 56614 - DNA, 100 bp, Homo sapiens
  misc_feature 35, 51, 70, 72, 75: n = A,T,C or G
tgctgagggggcaggcggagctcgaggaaaccgcngataagtttttttctntttgaaagatagagattantncanctccttaaaaaatatagccaatagg

SEQ ID NO: 56615 - DNA, 188 bp, Homo sapiens
aatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 56616 - DNA, 264 bp, Homo sapiens
  misc_feature 24: n = A,T,C or G
tggcgctgaggacccggaagccgntacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccgtgggtgttgggaagaataaatgtctgtatgccctggaagagg

SEQ ID NO: 56617 - DNA, 444 bp, Homo sapiens
  misc_feature 3, 32, 443: n = A,T,C or G
ggnatccttgggttttcctacttaatacactntaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtnt

SEQ ID NO: 56618 - DNA, 430 bp, Homo sapiens
cagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggaga

SEQ ID NO: 56619 - DNA, 373 bp, Homo sapiens
  misc_feature 8, 33, 93: n = A,T,C or G
gtgtcacnccctggttgagctggatctgtcctntaacaagcttaaaaacataccaactgtcaatgaaaaccttgaaaactattacctggaggncaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagccactcttaattaatatctgtatcctggaacaatattttatggttatgtttttctgtgtgtcaagttttcatagtatccatattttattactgtttattacttccatgaattttaaaatctgagg

SEQ ID NO: 56620 - DNA, 430 bp, Homo sapiens
  misc_feature 27, 32, 198, 355, 407, 424, 429: n = A,T,C or G
tacttcgctcgtactcgtgcgcctcgnttcgnttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgcnaatatgcactgtacattccacaagcattgccttcttattttacttcttttagctgtttaactttgtaagatgcaaagaggttggatcaagtttaaatgactgtactgcccctttcacatcaaagaactactgacaacgaaggccgcgcctgcctttnccatctgtctatctatctggctggcagggaaggaaagaacttgcatgttggngaaggaagaagtggggnggaana

SEQ ID NO: 56621 - DNA, 190 bp, Homo sapiens
  misc_feature 21, 46, 62, 67, 124: n = A,T,C or G
ccctgggccgggaggcagtanaggctgctgtgaaagaggctggctncacaatcgaatggttngaggngatctcgcaaagttattcttccaccatggccaacaacgaaggacttttctccctggnggcgaggaagctgagcagacccctgtgatgcctgtgacctcaattaaagcaattcctttgacctgt

SEQ ID NO: 56622 - DNA, 194 bp, Homo sapiens
  misc_feature 25: n = A,T,C or G
tcttagggagagactaaagaagatnatacatttgtgaaacaaggatataatagaaaaagagggaacgatcagagaacaagaaaggacgtcttgaaaaacaaaaatgttagccaaaattgaaaacaaattaaaaattaagagataaagtatttttttaaagaagtataggataccacttgaaaaaaatagaactt

SEQ ID NO: 56623 - DNA, 498 bp, Homo sapiens
  misc_feature 2, 13, 27, 39: n = A,T,C or G
cngagaatatccnatagaattcatttnagggttacactnaggtccgaatctatccattttactgagaccaaaacactaatgaaggtaatatttgttagctgaatggcaaaacaaatttttttctagaaatctcccttgtaaaatctccaaaactcttaatcattgcatataaatcaggacctgtaaaagtaaagcataattcattctctcctttaaaaagttatttaataaatcaaattgtatttaaattttctcagaactatatgattattcattcagaaataattctatggaaagccatcacaatttcattatcatttaagtaatttaaataagcatgtacaagtataaccacagaaatgtacctgttgacatactttaatgaagagattggcctatttgtagttagcccattgtttcatatgcatctgaagtggaccaaagattatccccaaatattaatattatccaaacttagattattatgccctattcaac

SEQ ID NO: 56624 - DNA, 277 bp, Homo sapiens
  misc_feature 39, 176: n = A,T,C or G
caccattggagaatggctatcctgggtataacagaaagntttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgncgatctttggaccagtttctagcaaagttgtgtttgaaagatactctattaaagaagactgtggaatctgtttatcggggcccattatatccttaagtttg

SEQ ID NO: 56625 - DNA, 237 bp, Homo sapiens
cttcagaacctagaccttccctctgacatagcctacgcaaatgagaaggaaacagaaaaccaaccctgataatatgacaaaacgaggctcttctacccaccccaaaatcacactagttcaccagcaatggatccaaaccaagaagaaatccctgacttacctgaaaaagaattcaggaggttagttacctaagctaatcagggagggaccaggagaaaggtgaaacctaatgcaagg

SEQ ID NO: 56626 - DNA, 370 bp, Homo sapiens
gaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtg

SEQ ID NO: 56627 - DNA, 175 bp, Homo sapiens
gtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacag

SEQ ID NO: 56628 - DNA, 450 bp, Homo sapiens
  misc_feature 139, 394: n = A,T,C or G
gtctaaaagttttttttaacgactgtattaaagctcttaggtaagcttctttatattgcaataaacaagtacttatatgcaagaaaatctcggcaaaatacattgcacaggtgctacgcatcttagggatttgaaaggngtgttatgtataaattagctgtcactttttttcaatcctgtaatggaatgatgagttgtaatttgcataatcctttaagaagtcaaattatactgtcatgtagcagacttaacatgctagctaagatttcagagctttgcagctaattactatgtaccttacaggacagttaaattgaagttgagtcctctgtctttgctgccatttgctttgtccattacttaacagaatctgcactttgggtaacgaggtgtngttactatcactgaagtaaacactctgctctgggaggaaatggcattttaatatat

SEQ ID NO: 56629 - DNA, 187 bp, Homo sapiens
  misc_feature 25, 179, 181: n = A,T,C or G
agagaaaagacagtttaagaaacancagaatacgcagagagaataaaacttcttaaagaactataattattatttgaaaagacaaagtaacttattctagccataaatgaagaataagatgctatataaaataaagaacaagaagtgaacaaaaaattgaacaaaaaaaaaatgcaatngngaaggg

SEQ ID NO: 56630 - DNA, 215 bp, Homo sapiens
  misc_feature 25: n = A,T,C or G
agagggaattgcatgtttgtgttgnatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttg

SEQ ID NO: 56631 - DNA, 500 bp, Homo sapiens
  misc_feature 5, 7, 30, 32, 56: n = A,T,C or G
aatancngatttgatatttaaagtcactgntnataggacaagttaatggatgtttnctatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaat

SEQ ID NO: 56632 - DNA, 212 bp, Homo sapiens
  misc_feature 160, 200, 209: n = A,T,C or G
acctggaggtcaatcaacttgacaagtttgacataaagagcttctgcaagatcctggggccattatcctactccaagatcaagcatttgcgtttggatggcaatcgcatctcagaaaccagtcttccaccggatatgtatgaatgtctacgtgtgggctnacgaagggggctcttaattaatatgctgggtgctggaacngtgtggggntgg

SEQ ID NO: 56633 - DNA, 500 bp, Homo sapiens
  misc_feature 452: n = A,T,C or G
gtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggngctgacctagacagagatgaactgaggtccttgttttgttttgttcat

SEQ ID NO: 56634 - DNA, 243 bp, Homo sapiens
cagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgctttttttttccagcaagtatccaaccaacttggttctgcttcaataaatctttgg

SEQ ID NO: 56635 - DNA, 439 bp, Homo sapiens
  misc_feature 29, 32, 165, 272, 357, 434: n = A,T,C or G
gggggcgagaaatcgctaggacttcgggnttncctcggacggccatggcctttaccctgtactcactgctgcaggcggcccctgctctgcgtcaacgccatcgcagtgctgcacgaggagcgattcctcaagaacattggctggggaacagaccagggaattggnggatttggagaagagccgggaattaaatcacagctaatgaaccttattcgatctgtaggaaccgtgatgagagtgccattgataatagtaaactcaattgcaattgngtactttttattatttggatgaatatcagtggagaaaaatggagactcagaagaggacatgccagtagaagttattacttttggncattattggaatatttatatcttagctgggtgaccttgcacttgtcaaaaatgtaaagctgaaaataaaaccagggnttctt

SEQ ID NO: 56636 - DNA, 147 bp, Homo sapiens
  misc_feature 30, 103: n = A,T,C or G
acgattatgccactgcactccatcctgggnggcggagcaagattctgtctcaaaacaagacaaacaaaatgaatagctgatcacatccattgtatttattgtngctgttctttaatgcatttaataaagaagcacatattttccccc

SEQ ID NO: 56637 - DNA, 201 bp, Homo sapiens
  misc_feature 10, 19, 30, 32, 38, 44, 45, 69, 72, 77, 123: n = A,T,C or G
atctgcaaantcccagagnttttcccaggngntcctcnccaagnnaataatcgacgaggacccccaggnggngttanaggagctgactaaggctttggaacagaaaccagatgatgcacagtnttattgtcaaagagcttattgtcacattcttcttgggaattactgtgttgctgttgctgatgcaaagaagtctctaga

SEQ ID NO: 56638 - DNA, 100 bp, Homo sapiens
  misc_feature 18, 69: n = A,T,C or G
ctttcagttgtgaagttnctttcgtgttacaccctccactgaaccctcaaccttcgaaatactccagtnttgtgggtttggtcatttttacttataaatt

SEQ ID NO: 56639 - DNA, 312 bp, Homo sapiens
acaacgggcaaatactggaaaccatcggaggcaaacagctcagagtttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaaga

SEQ ID NO: 56640 - DNA, 490 bp, Homo sapiens
  misc_feature 33, 56: n = A,T,C or G
aagtcctccaatgaaaacactctaattttgttntgtgtacctcaattttgtgaaantaaacggctgagtatactggaacaatcttaattctgttgaactccttaaaatgatattacatatcaaagagcacacctttaaactactaatggaggaaaatagaataactcaaggagagcaagcagacagctggaatttttgggaaatgtctgtggtatttgggtttatttttaagggaaagaaaaatttcccattaaattttataacacaataacacttttaaaacttatactcaaaaagaatctttataatgctgttgtaaaactcagattatattttattcatgaattacagatttctttttttgatgacggtggttagggtaagaagcggcttttataagctttatttatctcttttaattacctccttctccctgtctcaaaggctcacacttacactcacttttaaaaaatttttatctttcatggga

SEQ ID NO: 56641 - DNA, 481 bp, Homo sapiens
  misc_feature 23: n = A,T,C or G
gcaaacgaagaagtaagaaaatnaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtattg

SEQ ID NO: 56642 - DNA, 469 bp, Homo sapiens
tgatcatttttaggagcactgtaaattggccagcccttccagaaagtcataaaaatgtttgtctcctttgctcagtaattccacttctagacatttaaagaagtccagaagtattaaaagagctgaaactggatcccttccttacaccttatacaaaaattaattcaagatggattaaagacttacatgttagacctaaaaccataaaaaccctagaagaaaacctaggcaatgccattcaggacatgggcatgggcaaggacttcatatctaaaacaccaaaagaaatggcaacaaaagccaaaattgacaaatgggatctaattaaactaaagagcttctgcacagcaaaagaaattaccatgagagtgaacaggcaaccctacaaaatgggagaaaattttcgcaacctactcatctgacaaagggctaatatccagaatctacaatgaactcaaacaaatttaca

SEQ ID NO: 56643 - DNA, 335 bp, Homo sapiens
  misc_feature 24: n = A,T,C or G
tgaagcaaaaactcttttagctcngcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaacaactacattttaaaaactgacttaatgctcttcaaaataaaacatcacctatttaatgtttttaatcacattttgtatggagttaaataaagtacagtgcttttg

SEQ ID NO: 56644 - DNA, 452 bp, Homo sapiens
gaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatggctgaagctggagaagccgtggttgaagtcagcctacact

SEQ ID NO: 56645 - DNA, 329 bp, Homo sapiens
aggaagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcg

SEQ ID NO: 56646 - DNA, 466 bp, Homo sapiens
caacccggtgaaaccccgtctctactaattttacaaaaattagcccggcatgttggcgcacgcttgtaatcccagctactcaggagtctggggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcggaaaattgacaatgcctgcctgtgtaaatgtatggcttactgtcaaagcttcattcttggctgcatgttg

SEQ ID NO: 56647 - DNA, 191 bp, Homo sapiens
  misc_feature 25, 190: n = A,T,C or G
aagaacaaaacaggatgctcttaantaaaaacaggtgcactcatagaatagaaaggacctcccggaaaatcaaaagcatgatagaagaaataaattaaaagcctcatagaagaaatatagaactgaataaaatgtttggaagataaaattgaagacatttcccataacgtcgagcaaaaagagatgatcng

SEQ ID NO: 56648 - DNA, 327 bp, Homo sapiens
  misc_feature 2, 24, 92, 283: n = A,T,C or G
cncccagggagcaagccacacccngactgtgttgaagggtgtttttttttcttttaaatgtaatacctccccatcttttcttcttacacagngtctgagaacatttacattatagataagtagtacatgggggataacttctacttttaggaggactactctcttctgacagtcctagactggtcttctacactaagacaccatgaaggagtatgtgctcctattattcctggctttgtgctctgccaaacccttctttagcccttcacacatcgcactgaanaatatgatgctgaaggatatggaagacacagatgatgatgatga

SEQ ID NO: 56649 - DNA, 193 bp, Homo sapiens
  misc_feature 3, 4: n = A,T,C or G
tcnnaatacaactttaaatttgcccacagaaaccctctaaatcccctcgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 56650 - DNA, 434 bp, Homo sapiens
ggtacctgggtaacaaaacaacccctgtacaacaaacccctgtgacaggagtttacctaaataacaaacctgcacatgtacccctgaacttaaaagttattttaaaaaaggcctcctttggtcatggagatttgtacacaaacacagagcatcttccattgatcctcagttaaaggcaccctgcagttatttaaccctgacttcacataccaaaggaagtctaattatttgatgtgtgctaaacatcctcagtgtggtgctgctgttcagccacattaaattcacaggacaagtctgcaccctatgtagtacagattgagtatccttaatccaaaagtctgaaatccaaaatactccaaaatatgtaactttttgagtgctggcatgattctcaaaggaaatgctcatcggagcatttcagattttggattttg

SEQ ID NO: 56651 - DNA, 245 bp, Homo sapiens
  misc_feature 24: n = A,T,C or G
ataaggcagaaaataaaaaatatnagaatttcatggattacaaagaaataaaccactacttccattcactgtaaaccagagaagaatatatagggaagttagaattcagtgtgtacccttattaataaaactagtgttttattaataaactataataaactagtgtttattaataaattaaattttttcaaattttttctgctttctcaatagatgctctattttctcccctcctcctattccac

SEQ ID NO: 56652 - DNA, 490 bp, Homo sapiens
  misc_feature 1, 7, 57: n = A,T,C or G
nattccngaagctgacagcattcgggccgttttgtctcgctccgtggccttagctgngctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacact

SEQ ID NO: 56653 - DNA, 184 bp, Homo sapiens
  misc_feature 42: n = A,T,C or G
tatggcccgggaaattgcgagtggtaggatgaaacaatttgntgaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagc

SEQ ID NO: 56654 - DNA, 125 bp, Homo sapiens
  misc_feature 55, 63: n = A,T,C or G
atacaagttcccccagtgatagggatcctcactgatgtttaacaaccactgctcnagaggggngggccagctgccgacatttcttgtgtcctaattgtgaggaaggttcttaaccatagaatgtt

SEQ ID NO: 56655 - DNA, 275 bp, Homo sapiens
  misc_feature 33: n = A,T,C or G
agggacgaaagagctgtttttatcttcttatcnctcccagcctctactcttcccagcccctaatcccaggccttggtgtacacactgtagtttttccattatgatgagtatgtgcagtgatactattcatgtacagtctgagcttatgctcaggggtgtgtgtgtatatgtgtatgcatgtgtgcaccgtgagtgtgtgtttctttttccagttcctgcatcctattttgacactggttgtaagaagatcttgatacatacaggttagctgttac

SEQ ID NO: 56656 - DNA, 428 bp, Homo sapiens
  misc_feature 24, 26, 427: n = A,T,C or G
aggagagaaagcctaagaactgancncaaaagtctaaatgctcttaatgcagctgaactagacaaataaagtatcagatcgccaagagattaaccatgttaaccccagtattctttttgtggctgtggttggcattaaataggaaagtgggtggacacgtagggatagtagtatttttggttggcttcaagctttgatgagtttttgtgtgttttgttttgttttactttaaaaacctgctttttaaacacgtaaatccttatttggctaattttcagggcacagtgtgagtataaactcatatgagagtctattgttctctagaaactacagattaaggtgtctttaacagactgatgtctaattattacataaaggcatctgatttttataccaggacacctataagcacattattataggaggng

SEQ ID NO: 56657 - DNA, 342 bp, Homo sapiens
  misc_feature 24: n = A,T,C or G
tcgctcgtactcgtgcgcctcgcntcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgc

SEQ ID NO: 56658 - DNA, 179 bp, Homo sapiens
  misc_feature 11, 16, 26, 28, 179: n = A,T,C or G
acgtctaaacnaaacnctttcaccgntncacgaccgggggtatactacggtcaatgctctgaaatctgtggagcaaaccacagtttcatgcccatcgtcctagaattaattcccctaaaaatctttgaaataggacccgtatttaccctatagcaccccctctaccccctctagagccn
